United States Patent 10,619,170 (CRISPR-CAS SYSTEM FOR A YEAST HOST CELL) - sequence listing, part 11

SEQ ID NO: 6 - DNA, 10729437 bp, Kluyveromyces lactis NRRL Y-1140 (residues 8,583,553-10,729,437 of 10,729,437)
  misc_feature (5631879)..(5631879): n is a, c, g, or t
  misc_feature (5631991)..(5631991): n is a, c, g, or t
  misc_feature (5631993)..(5631993): n is a, c, g, or t
  misc_feature (5632001)..(5632006): n is a, c, g, or t
  misc_feature (5632008)..(5632012): n is a, c, g, or t
  misc_feature (5632015)..(5632015): n is a, c, g, or t
  misc_feature (5632018)..(5632025): n is a, c, g, or t
  misc_feature (5632030)..(5632030): n is a, c, g, or t
  misc_feature (5632036)..(5632036): n is a, c, g, or t
  misc_feature (5632038)..(5632041): n is a, c, g, or t
  misc_feature (5632058)..(5632059): n is a, c, g, or t
  misc_feature (5632089)..(5632089): n is a, c, g, or t
  misc_feature (5632091)..(5632098): n is a, c, g, or t
  misc_feature (5632110)..(5632110): n is a, c, g, or t
  misc_feature (5632114)..(5632114): n is a, c, g, or t
  misc_feature (5632136)..(5632136): n is a, c, g, or t
  misc_feature (5632140)..(5632140): n is a, c, g, or t
tgggtgaataagatggtgatgtaggagaataagatggtgatgtaggagaataggaaggcgaagttggagaatatgaaggtgatgttggggagtacgatggagatgttggggagtatgatggcgatgttggtgagtaggatggcgatgttggtgaatacgaaggggatgtaggagaatatgatggtgacgttggtgagtaagaaggagatgtaggtgagtaagacggagatgtaggtgaatatgatggcgaagttggtgaatatgatggtgaagttggtgaataacctggtgaggttggagagaatcctggagaggaaacttctccaaagccaggggaagtagggccgttaccatatccactgaacggagaggttgcagaaccatagtcggccccaccataagcagtaaatccaccagcgagagcgtctgctccccctgattcaaccaaaggtgagaacattagttcgtccttaacattaatctctgcgtttgcaagaccactttcgttggaatatggtgtagcacctccttcttggccttctgtcttgacttctttatgttcaggcatgtatttcactagagattcgtcatcaatcatgacgtcaaatgcaccggtaccaattggcgccatttgacctaagatgacattctcagagacaccacggcaatcgtctaactctgctgccgcacctgcctcgaatagaatttccacagtttcttcaaaggagcatctcattaaagcaccagtgtcggctctgttgaacccgtgacgggtaacagacattaagaaaccttgtgatgtcatgacatcgactaatagagccatatgacggtaattaacataagaaccatcggaagcaataacattgtacacttctctgtataaggccgcacgaccagcctcaatacctaatacattcattatgtcaatgaaggagtttgtgtagatacgtgagccatctacaccggacactgtcatgacttcagaaagattcacaccatctgtttctagaacccattcgggaactttatggtattcaccggtttcactagggacttttctatcatacttcatcatcaccacacgtgtaatatcttcgacaccacgcagagtgattttctctaacatagaattttcgattttcttcaacatgtgatcttcctccgcttcgacgtctgcgtccaaggtcttaggatcacggataacacgacaacgaataatcaatttctcagcattatcttctgaccatataacgaacaagtcgttcttgaatgtctccttgattttttcaccgacttgacccatagttaagtctttatcagtcattgccgcacgatcaagttctagacgtaataaccatggagattgataatctagagatttttctgtttcctcatccatcaaggagaagtgtaactgaataatttcctcatcatcttcaatgacagtcgaccgagggtctgggtcataataaatttcagatgcgacggtgacactctttaaagttgtgtgttcaatagctgaacggatttctttagccttctcttggtcagcagcgtactctggatctaaatacacagtaagagacggggtcttcatatttttggcgacatttaaaatttcctttaaacgaggaacacctgaagtaaccttcttggaggccacaccagcgaaatggaaagtattcaatgtcatctgagtggcaggctcaccgatggattgagcagccaaaacaccaaccatttcacctggatgaacaatagatcttaggaattgtgcttcgatattgtttagcacccaatcaaaggtctgtctgttcaatctgtattcttcaatcaccctacgtgtagctagacgagaacgcaataagcagcagaataacgtgattgcattttgttgagcttcttttaagatgtcactcttcccacgtacgactagaagcttctcctgtaatttccttacgcctgaaataacatcttcaattgttaaatcagttggtttggtttgatcgatacggaatgtttgctgtgagttctggataatacgcttgatgttaacaggtagaggccaattgtgttcaccatcgacaaacacccttctcaaaatttgacggtcatcaacaagctgtttgtactcatcgttaagtagtaattgcaattttgagtctccgataatttcggatcctgattccaaaagagagggatccaaggcgtactcctcatttaataggtcgattctgtaacgcctttcgaaagcactatcagatccaggaatagtatcaattgactgcttttcgatgtgcgctgcatccataccatcttcaccatagatgaactgtataacattccctagagagtttcttgttgtaccatcataatggaccatgatatcctccaaagctttgaccaaacgacgttgaatataacctgtttcagctgttttcacggcggtatcgattaaaccttcacgaccacccattgcgtggaagaaaaactcttggggtgttagacctctcaaatatgaattttccacgaaacccttggattcaggagaataatcgtctttggagaaatgtggaagagtacgatcagcgaaaccgaaagcaatacgtttaccttcaacagattgttgaccaacacatgcagacatttgagcgatattaataaaggaacccttcgaccccgcactaaccatctgcttgacgttatttaaatctttcaagttgacttctgctgaacgaccagctttatctctagcttcgtttagataacgaacgacattatcttcgaacgattcacgcaatgtcataccgtgttttgccgttaataagttcgcttgagcctctttcgtgacatcttcgaccttcttcttggcaacagcgatagcttcagtaatctccctcatggttttctcatcagcaatggtatcaccaataccaatggagaaaccattatgcaagagccagtaattgacaaccttttggatgttactgaagagtcttgcgcaaatttcaggtcccttttctctcgtaaccacgtggattaaaccaccactagatgaaccgacggtcttcttgtcaacaacaccaaaaatgattttaccatcaatgatcaacataccattgtcttttggtgataagaaagttgttccatcatcaaaacgttgtaagtgaataccattaggaatagccatggatagcacttgcttacccgaccatagtggtactggcttcaagattgcaggagtggggataattccgtcccagtcaggaatccagtaaagcatattcaacacttgatccaattctatgaaagtgtctcttagagtcattttacgaataccacataatgtatcctgcacaatacccatacaaggtttgttagattgtggggacacaatttgcaaaggcactgcacataactgcgacaattcggctctagtctcttcagattggggaacatgtaaattcatttcgtcaccatcgaaatctgcattatatggggaagtgacagataagttcaatctaaaggtagaatatggcatgactttcactctgtgagccatcatagacattttgtgaagggatggttgacgattgaaaagaactggatcattgtctgtaatatgacgttcgactttccaaccatactgaagttggatgtcaccagctcttttactgtaacgtaaatcgatacgatcaccactttcacgaataacgtatttagcacccggatgctcatttggaccattacgaactagttgagtcaaccggtcaatattgtaaggtgtgacgacttctgggtatgttaaagttttggcaatagattttgggacaccaacttggtccaagtctaagttaggatcacctgaaatcactgtacgggcagagaaatcaacacgtttacccattaaattacctctaatacgaccttctttaccttttaaacgggcacgaatggatttaataggacgaccggatttttggacagcttgtggttgaccagcaatatcattgtccatgtaagttgctacatggaactgcaacaaagactccgattcttggataacgtgttgaggggaaccattgatttcaagtttctgaacgttaatatttgccttcaagatatctcctaatttgtatgttaaatcatcctcacctctttgtgattcgttgaaagaaatcgatggacgaacaggtggaggtggaactggcaagacggtcaaaatcatccattcagggcgagagaaatcttcattgaatcccaatctccaaccatcttctggtgagatgtgcttgaacacgttaagaatttcttcagcagatattattcgcttttctggttgatctgagtcgtcagcatttttatctttcttccatgtacctactaaactcaaaccatccttacgaatgcttggttgaatgtgaccacagcctcctctcgagaggaacactgttggatcatcaggagatggaacttctgtttcacaaaccatcttagctttgcacagagtccacacggcgttgaaccttctctttggatcctttatcttaatagcttgtctcatctgttcattatattcatcaaggagtaatttaccacaatgcatacagacagactcgcagaccttcttgattttcgagaggaaaccaatgtgaaacacaggcttggcaagttcgatatgtccaaagtgacctggacattcggccataccttcaccacaagtttgacatttgtagttacgatctatagatcctagtcttgggtcattaagtccaccaatcttagctttcatttgactctcatccattgtttctgggaactcgattttagccactgaaatgccacgaacttcttcaggtgagaaaagaccaaactggacttcttttatggtacgaagaggagcactagaataaggaaaatcgaccatcttttacgtttaataggatgcttttttggtggagttttttttgttttttgatatggattaatgtttattatgttagaataagctggaaaatagatgtgttgatgatttttgtaaatataatacaatcccttcaaaataatgtttgaacaatatgatggacttttcctacagtttcttggccgaagtaacaagtggtgggataaaaggagccaagcagtgggttatgtctcttgttgttttctgttgttagtcaaatataattcttgaaggaaaaataaatgaataaaaatgcaaatgggtaaaggaaagctgtaattcgaaatctgtttattgttttgtagatagcacagttcgctcaatcccttgaatacctctatttttttggtagtttttttctgttagtttgcaagtgcaataagcgcttcaaaggaaattcgttacttgtttcaaaggttgattcccaaaaataccttaaatccaagataggagtgcaggcttatcggatcacgattaaagcagcaggcttgcaatttccgcaaagttatgaaactccttaaatgtagctcaatagattgctttcagatggtttatccacacgattgatagaaaacactaacaatcttcaaatatgctgtttatttaacgtaacgtaacgcactgaaacgacaaagaagtagctaatgtggtagccaaaagatcctagaggggtacagagtttggtgtttggagtggggaggtccaaaatgccggtgtatgagcggtgacttttctccttgaatgagctgttgcatgtcaagcattgtttttggccattgttttctttattctttgccacttgaacaaagttgaaaatttttggatgtcgtttagtacgcaatacgtatgaaatgatagggatctgctatgcattcgagaatagcggaacgtacttatgtccgtcatcgcaagaagcatactatttaactgatggttaattacttgaatatttccatctgattttactttgataggtgataaggattttgaataagatgtgaggaaatatatagtcagtactaagacacgtatccattttattttgttttataagaggaatcgaaattaggaaaacattttggataatgacttcttctgtttagcaatcaactcctttttggctttcttggcgtcttgtaaagcctttataattgcagtatcatgtggttggtatgtagtagccaattcgaggtctgtcacggccatttctgcgttttttgtgtagtaataagctaaaccacggcgatacaatgccttggccttggatttatcgtctgtgttgtcagcatgaagggcttcagtggcggcgctaagtgttctactgtaatttttactcttgagagacaccaaagcgatgttcaagaataaggatacccttaatgcgtcaatttttttaacatcctcctctggtaaatcttgagggaagtactgcttaagcatttgactacttttttcatatttcacaagggctacttcaaaatttttctccttgaattgtttagtaccgatctcttttactgcttctacagcgttcaagacactattgacgtcgttgggatcaaccttcgaatcgtctgttatattttcttcataattgtcaccatacgcatcagtcggagtcgcttctgcatctgcaggaacagtataatcggatggtaacacaccacaatcctcaattttaacctctttggccggcttatcagcttcatctgtagcattattttctatagttctgactaaccttttgccctggatcacttcaccgaaaacaacatgcttaccatctaagtgtggagttggaacgcatgttatgaaacattgagatccattggtattcgcaccagcgtttgccatagacaacaagaatggcttatcatgcttcaaagtaaaattctcatcttcaaatttctctccgtaaatcgattcaccaccagtgccgttgaagttagtgaaatctccaaattgacacatgaaagacttgataactctgtggaagatcgagcccttgtagctcaatggtatatccggtttggatttggcaaatcccgagttaccttcacagagttttaagaaattctccgccgtctttggaacaacatcagaatacaactcgaaaacaatccgaccagcaggtttgcccccaatcgaaatatcgaaaaatgtcttaggtcttgtttcactcatattcaaattcaatgagctaactcgtatgtgtacttttttctccacgtaggtagaaataatgcagggttagtttgcttcttcaaaataacaaccgctttgccgtaacctacctttaagatcaatgatacaagctgggtttgtcaagagaggttactaatggactttactcaatttatacttctttttcagccgttctcattgtacttttgttgtggttttttcaaggctagatcgataaaagatggaaagcttcgaatttgctagaaaacctttaaaaatatatcaatacatgaacgaaccgtaaacacagtgataaatgaatatctgaagcgcctgaactaattactttcaggattaggtcttaacttcttcatataaacttcattactgttatctgcttcagagccagatccctcatctaaaccatcggcttcgagaccagattcagactcggaccctgtttctgaatcgttagtttcgtgatcttgccaaaccgatgaattatatgatgagtctttaatatccataatgtcattcagaacacttttataagacactgaaccaccatctggtagcgaactatgtagaactgatttttcgttgctcaagtttcgtaaatggccattatcttctatgacttctccagtttgtaaatctattacatcaccttgattatctatactttcatatttttgtatgatctgggaccatacgcgtttcatattctcgtctgctttcttatgacgctccataacctcttcgtctgacaatttaggaattaatcgattctctttagacatgatgtaaaccacaccatctcgagtaatttgttttagattctcttctttctttggctcctcttcgcctagcaaatcccttaatgcacctgtcaatcttcgaagattagccttcttcttactatttgatggtcttttaatcatcaataaagcactattgctgtaattctacttggaaacttcacctatggtccgggaactggttaaatttcgttatgttctggtgtaaatgttgtattgaaacgattattcattatccttaactaaaatatgtcaatttaaatgttgcgctgcgtagactaaaaatattcagatgggtattcgcatatacaattaaatgggtctatatacaatatgtggagtatttcgacaaagcttcacagtgaaggatctttttacacctgtaaatgcaaatctcaatgttcttttgcatcgactgtccccactctctggtcattacccttggattgccaacaatctttgaacagtttcatttcaccaagacactgtctccaatcattagtctctgcatggcaaagttgtaaagctagattctctacgtaacagcctgtgttcgatattctcttgtcccaggcatcaggatcttctttatccatatcctgatactccgctaatgcttccttgtagtattttgattctcctgcagacataattgaaagtatgaagctacgacagaataattgctattgactcggtcaacgtatcactgtagactgtgatagtcgtttcaagattaactgttgcatgtactattgcacttattgtattgtattctactaaattaaccatttatacttcagtgtttttacttttccaattaaaccttgctctcgattgttctttatggccactgaactaattttccgttccaaaagcttgattgagctacaaaaggtttaatgactattaatataagaaaagaaagctgtgttaaaaaacgtcagagatccccaaactgcaatacaacactattgatctatgtaataaacgaccaggctgcggtttgcgttggcgtaattgcaccgggagatcacgtgatataaatgctttcaagattatgcaatctccaggcacacaacatattcagtacttagtgcgggatacctactataaactcaataattgtacagtaacataggtagtaagatcccttttcgagtatacattgtccatgttgttgtccctttggatggtgtctcgcctaattttgggccagatctcgactgcaaaaaaataatttgctgaagtttttataaatgatgggaactgaagaaaccaaagaaattgaagattcaaaatatgtaaaccgaattttaggaaaacaacagcttgttctgatctttttcagaagaataaaaggtggctaaacagtgttacacgtagcattgagtttgcgcatcaatattagctaatacccgtgtgataacttgaagcaatggtgaagctagctgagtatccgcgtacggctacgttttcatggtctcacgatagggtgccagttttggcgactggtcctgcatctggagccattgatgctgatttttcaagtacttcgacattagaactatggtcgctattgtcttttgatgggtctaaacctagtggatctgttgtcgctgacggtaagttcaacgatttggattggtcgggcgatgacaaaataattgctggtgccttagaaaatggtgttgttgagtttttcgatccaaaagccttgaaatctgttgctaagatccataaacatcagggtcctgtcaagacattgaagttcaatgccaaacagaacaatgttcttgtctctggtggcactcaaggtgaaatctttgtttgggattcaaacaagatcggatcttcagattattctcctttttcggctggtatcagtaatactccaatcgatgaagtttcctcgttgtcatggaaccaatcgttggcacatgtgtttgcatcagccagttcttcagggtatgcatctgtgtgggatttaaaggcaaagaaacaagttttgcatttgaaccacagttcctctaccactggtattaaggtcccattgacggttgttgactggcatccaaccagctctaccattattgcaaccgcctctagctcagatacagaacctcttgtcctaacgtgggatctaagaaatgctcatgtaccattgaaagtgctatcacaaggacattcaaagggtgttttatcgttggattggtgcaaacaagatgaaaatctattgttatccagtggtcgtgataacacttcggtgttatggaatccgcaagaaggctccatcttaactcagttcgctccacgtggtaactgggtctttaaatccaaatttgctcctgaagctccagatttatttgcatccgcatcctttgatagtaagatcgtcgttcaaacgttgcaaaatttgagcaataccttggatgctcaggcaaatgagagtaagcaacatgcttctgaggatgaattctggaacaatgtaacctccaactcagttgatgacaaacctaacactgtcaagatccaagccccaaaatggtacggcaacaaatctcctgccgctcaatgggcattcggtggtaagctggttagaatatccgatgatggtaaaggtgtcagtgtagtaaaaccttgtatttctggactggaaaagaatcagcttttcgatgagtccttgaaatccaaggacttcgtgaaattgatcaataagagattatcacaaaagatcaacgcaacaaacgaagatgactggaatttactagagaatctatctatggatggaactgcactttacttgaaagatgcattatcattagatgatgccaaagaagacatcatcaaaaagtcagaagaagatggtgctgacttcttcaaccaactaaacgacaaattcgttcccgaaggcgctttcaagcttgatttttctgaatcaatgaaaccactcactaactttttgatcaaaggtgatttgaaatctgctttaaatcaggctttagagaaggacttgttattagaggctttggtgatcgctattacttccaatgatgccttgttggcggataaagcgaagaacgcctacttttccaagcattctgagcaatctgggttggcaagaactttattctctgttgctcaacgcgatgttgaagatattgttacaaacatcgatgtttctcaatggaaagatgctgttcagttcattttcaactacaccaaggaagatatctcaaagaaaaattcacttttagtaaaattaggtgatagattactacacgagggaaacagaaaagatgctattttattatatttgagcggccagtccttggaaagcattgcgtcaatttggctgaaagaattccctgaacttgaaaatcaattgacgtctcaaaaggacaccttatacgaggcccatctggaatgtttaactgaatttgtggaaaggttcaccgtgttatctgactaccttgacaaaggtactgttaaattaactaatcaaacgctaatctcaaagtttttggaattcgtcaatgtcacagctgccaatggcgatttcgagctttcattaagatttttggaaactttaccggacgataacgaagaggttaaaagtgaaaagcaacgtgtgctgattgcctccggtaaaacaagtactactaggtcaacagaaaggacagcaaacagtaccctacaatccagacaaggaagatacggttcaacttccgtaccaactgccaatggtgcgcctcgtttatcaaactctggaattcctcccccaaatcctttggctgctcctcatcagcctcctgcctcaactgctccaaatgtcgtcccaagaaagccaagcttcgttccacagacaacttctgcaattccaacacccaatccatatgctccggctgcggtaaatcagcaaattcctctatctgttgtgggttccagaccatcttacacgccaccagtgaacccatatgcacaaactgctacaagtatcccacctaacccatatgccccactacctgtggcagcgcctgtaccacttggctctccagtcgctccgccaccaatttccggtgctagtggatattctggtcaaacgcctcatctacatgataaaccaatcgacggttggaatgatctcccatcagtaagcaaagaaaaaccaacccgtgccaaggctgtcaacacagctccaattggcatgtcaactccatcgtatggtacccccgatcttgcagcggttccactttcgagagcatctacaaactcaacgctcccaccaccaccgcctaatgtgagaagaacaccaaagcttacttccccacccgaagttgcatctcctccgctaccattaaaaaagacgaactcttatgcgcctactgtcagcgctgtacaatcttctcaaatgccacagcaaatatcaaatcctttaatgcctccagcttctccaaacccggctacaaacggaaggtcttttgttcctcctgtaaatccttacagtcctgctccatctgcagtcacgcccacagggattgtgccaccaaaagctttagtagctgctataccatctccggtaccagctcctaaagctgcagccgtccctccaccaaggaaaatgaataggaaaagtactgccgttggtgatgcaagcgcagcaagcaatcttctaagctcaattcagaccaaacctacccctccaattcacagtccagctatggtagatccggtagctgtacaatacgatcaatctgcagtgtcacctacaaatgtcgaaattgcagcggaacagggtgctggtatcaccgagagtgacaggcctattgttgagtttttaactgcagagctacaacgagtgacacctttaattccacaagaatacactaaacaattgaaggactgtgacaaaagaatcaagattttaattaaacatttggaacaccacgacttgttaacccaaccaacgattgacaaattgcatcagatcgttgctttctggaaggaaggaaactactctgaggcgatgactattcatcaagatttgtcagcaaaccatagctctgaggcaggaaactggttgactggtatcaagagattaatgaacattgccgaagctacctcttctcaatagtttttgttggacaacaacaacaacattatgcctccatcagatatcattgtttctttattgactagtttatttaatggtccatcgcattcttcacgataacatccattgttttgagaaaatcggccaatttgtacaaaacacattatatagcacgacatctagctcaataattaggatgtgtacatactgatttcttcttatctttattctctagcatgtgtgattaacacattgattcgctttatgcgaagtgccaaaaaatcaaaaaaatcaaaaaagcgatggctgaacaattgttgaacatgagataataaccagtagacataattagttatatagtttcctggaagggtattgccagttagaaagtccacttaccataatattgaacgtcgttttgtcgacctttgcatactatctgagtattgttcacccaagcattttctttttgttgattatagtcgaagattttacagtccaaaactctctcaaatcccttgagcaattgatatataacattgaccaacatctgagaggaaatcaaaaagatagcccgtctgataataacaaccatcacatatcacttcaatcgcatttaacttgacaaaaagctaagtttaccagtactatttgcaagtacctagagacccaaactattatgactacggctcaacgatcactatgactactgattctgttccacgaaagaatatttctcaagctatcaaactagtgtttcttcgacggaaagcacaagagcgtaacgaggcaggctcctctgaagtaccgacgggtggtaaatcgaataatgcttccgctacatcgtcacccgaagaggcacttgagaatagtggagaaaacttcgaactcacaaatttcgcatctttatcagaaatggaatcagaaatctttcttgcacctcccgccaaacaatcgaagaagatctccattcttgttggtatgtttgttgctgtgggtggatttttgtttgggtatgatacaggattaataaataatatcagcgaaatgccttatgttaaccaaaagtttgcacctaacaagaatcatttcacaacaccacaaatctcgatattagtgtcttttttatccttggggacgttcattggagccttactggcacctttaatctccgactcttatggtcgaaagactacaatgatctttagtacgttcgtggtatttatgataggaaactctttacaggtggcagctggttctatgaccatacttgtagttggaagagtcctctctggtatgagtgttggactaatatcggctgcggtgccattatatcaaagtgaagctgcacagaaatctgttcgtggtgcaattatttcctgttaccagtgggccattacatgggggctacttgtagcaagtgcagtttcccaaggaacatataaaagaatggatgcatctagttaccaaataccgatcggattacagtatatttggtcctttctactcggtgtcggcattcttttcctccctgaaagcccaagatactatgttttcaaagataggctagacaaagcggcaaaatctttatcctttttacgtggcgtaccagaggatgactccggattacttgaagagttggttgagatcaaagcaacatatgattacgagatgtcattcggaaaaatctcttacctagattgtttcagatcaacgagatcaagaaccaaacagcgtctacgaatgttgaccggtatcgctcttcaggcttttcagcaagtgagtggtatcaattttatcttttattatggcgtagactttttcaataagagtggtgtcagcgaaagctatttggtttccttcgtcacatatgcagtaaatgttgcgtttaacattccggggttattcttggtcgaatatatcggacgaagaaaattgttattgatgggtggtattcttatgactatctccaatttcattattgctatagtcggattagcgactgactccatggttgcgaacaaagtgatgattgcattcatctgtttattcattgcatcattttcggccacctggggtggtggtgtgtgggtaatttccgctgaattatatccattgggtgttcgcgctaaatgcaccgccatctgtgcagcatcaaactggctaataaatttcatctgtgcattaataacgccttacattatgcacatagatagcagtgtcagacaaacgagtatcggtaccaaaatcttctttgtttgggggtcattgaacgctgttggggttcttgttgtgtacttcaccgtgtacgaaacgaatggattatcattggaagagatcgatgagttgtacaagaaatcttcttctggaataaactccatagaatggaacaagaagatcaaagcctttccagatttgtttcaaaggacaagaccgaacaatgaaggtgacggagaagctgatgataacatacatacagatgaaaattataaccatactatttccagctataatggaacccaaaacaatgaaaaatatcctattcaagtacagatgccacaatttggtgtacggaacatcgaatttttgaacaccacaggctcatctccgcaatcggatatgacagaacccaactttgtcgacttgggtaatggtcttggtataacaacgtatcaaagaggcccaccatccgtccttactgactcgagtgaagaagaggaagagggacaacaacaagagacagatgagactgaggaaggtaaatcattcaaacaccagtacactgacgctcgtaataaaaatcgtggcgagcgcggcagtttcaatagcaatagttcaacctcaggcactactcgatcttcttcccacaaggccagtgttcaaaggatggaagaaattaatctgtacatggcccaattaatgcatcgcggaggaacagaagatctttcgcgtaacactaccgataacactcatcaaccgatatcacatgatatcatgagtcaatggaactcctcatcccaaaataaaggacctagcactcaaaccgatattaatagtaacacttaggaacactaactaatcttataatagtactttaatatataatttattacatgttgaatgacgcttaccggaaggagtatgtaaaatcttacttttatcttagccgttagaaagtgtaaatgcttgaactcaaacaattcagaatcaagtagagttcatgtatcatgctgaaaaactgagtcgcagctacacatgttagcgtgaatgctacttattatgcgaagatgtttcaactttgatagcgggatgatgtctcgaataaggaaaacaaaaaaaactagaattaatagttaaggattcagtataaaaaggacacgggatggaaaatagttgaaacaaacttttgggaaagcgcggaagtgaagaacaacggtcgaaccccaagattggtgatacgaatatacaccaccgtgcgaggttgtaaggttgcttaacgttaataaaaggagggataaggagtgaaaacagttacgagttttatatatttattcatttctgtctggcaacattgaaggaacaaaaaagagactatcagaaccgctaagtgtctattatagagctaccccatccaagatgtcaactgagagtgatttaaagtctcgagttccacctgctaccaaaactccattggatgtgtcagtttctgggttgaagaaaacagtgacacaagttatgaacacggatgttgatgatgtgttgaaacgtaaaaatattaatacaaaccaaaagttcagcgggaagatagaatatgccatatacaagacgcttttgatatttctctacgtgatatatgctatcactagatatttccaacgtgaatacaatagaattgccatcaaactgttggacttggcgtataatccttcgaattcaccacagttgatcaggcaggacgtgaataaattacagaagatccctaaaaggctagcggcaatcttagaatcaaaacccgagggtgacataggtggaggtctaccgggactcatcaacgacgcgagtgacgtggtatgctggaccgtttctgccggaattaagcatttaatactgtacgattacgacggtaagatgaaacagaacgtgcatgaactaagagccggcatccatcataaactagcgaagtattttggtctggataatgtacccaagttcgcaatcaagataccgcatacaaaccaaatctttttcgacaaagacgaggatcagaaggatttatcgcctgaaaagtcaacgacaaaacataaggtggccgttgaaatttctttactatccaaagttgatggtagagacacgatccttgaattgaccaagacaatggccgatctatgtgccaagggccaattgaaggtggaagacgttgatacgaaattagtcaaccaagaactaacacagctcgtaggacatgaacccgatttacttctatttttcggtcctgcattggatttacaaggattcccaccatggcatatcagattaacagaattatactgggaaactgacaacgatcaagtttcatactacgttttcatcagaggtctcaaacagtatgccgattgcaagatgaacgtcggcaagtgaaacaaactgtacaacatcatgatatattgctaaccagataataaataggtcataaccctctagctacataatgtatacgctcatcagactaataaaagaaaaaaagacgaaacgatattgctggttgccaactctcacgtcaggtcgttcaatatcgttgttaccatgaaatgacaatcccaatacagttaccctactttgacacgtagagcctaatttttttttttcccgtcccatttggaaaaagcatatataaaaaatagcaagagcattgataaggttaccattttgtttagatctaattatatacttagcccacattgaaagggagcagaagcctcagcgataaggaagtatgtttcccagcgcgtaacgtttggtatcaaggtaccggcgagcaacgaatttggacgttcaaacttggtggaattgcaattgtaacacgaattacacgcgataaacgcgtttccgatctgtgcgaattgggtgttcctcagtaaaccttgccgcaattatttaccatttgtcaattttcaagtttttcatcctatattctctgtttgtctgagaatattttattgggagggaaaagaaaaaaaacatttgtgcgggtgtttctgggttatatccactgaagaaaaaaaaaagacagtaaatcgcctcaattagttaccaccgatagacgagaagacgaaaattagtatgggaggtaaagtatcaccggatcttggcttggctaagactcatgtcctaaggaattggagtttgtttgtgtgtctctatcatgtttgattttttgtttatggatgtttttctttctctctctcttgtctccttttttttcctgatttgaatctatttttttttcagttctatgttcaattgttttcccactataataagacgttccatttattctctgatcgtttttactaactgaatttctgaattcttctccttgcgactgagtttcggtattaccttaattctatcgattacagttgggattaaatttgttttctttaatttataggaaaccaagaacttcataattctaaaaagcagtacaagatgggtgtttcgttttctaagttgttcagcaacttgttcggtcataaagaaatgagaatcttgatggttggtcttgatggtgctggtaagaccactgttttatataagttgaaattgggtgaagttgtcactacaattccaactattggtttcaacgttgagactgttgaatacaagaacatctcattcactgtttgggatgtcggtggacaagataagatcagaccattatggagacattactttagaaacactgaaggtatcatcttcgttgttgactctaacgatagagctcgtattgctgaagctagagaagtcctacaaagaatgttgaacgaagacgaaatcagaaacgctgttctattggtcttcgctaacaaacaggatttgccagaagccatgccagctgccgaaatcaccgaaaagttgggcttacactccatcagacaacgtccatggtacattcaagctacttgtgctacttctggtgaaggtttgtacgaaggtttggaatggttgagtactactttgaagaaccaatcttaaatgggggttttaatgaaatgaatcaataaaattaaaattacaacaacaacaacaacaacagcaacctatttacaaattatcaatatccaataacaaaaaaagaaactgaaattattagaatattcaggaatatagataattccaacagatatatccgttattaattttttttttgttccttcttctctttcttacttttatttcatctcctcctataatattgtcaaggttatacctctattctgaaccagcatgccatatatttccattacgaacgaattataagaaaaaaaaacctacacagaaacattgcaagagggtaggaatgacagataacgaaacgagactcgaaattaattaaaccacaaactcaatttccttcggatatcagttcaaaaaaccctcgatttttgcatcgagatcattgaatgaaaagaacataataaacatactcgggaaccgcatcaaattcttcattcgtaccagtgacaatgacaacatatctacatgaaaactgaagcgaaaataaagggatttcgaataagaattatcaataaaatatctttaatcatgcacattagtggataacactgattgatcatcctcttttctgattttggtccccttattgtttattatcttctgcttctcgtcattttctgtttatcttacaatatcgttatatcatatatatactttaggtttatccaatgtactatcgaaatctacaaagcacgtgaattcgtcctaaccgtaaattttattcacattgattcaaacacaagcatcgtttttaacaattcgtacgcattcattcgttaccatgaacaactttttaacaattgcactcttaaacgatatccaatgttcacgaagacactgctcgaacttgcctttttttaattgagattataacacgtgacagtacatcggttgtttcctaggactgtttgtaacacccatacattataacgattcatttgaaataaaacaacacccagacatcacacgagacatctgcaatccgaccggacaaaactatatatatttcccaaaatagaaagaaagctcacttcctcctgggatttttctttcttttctagttttccttttacagtaatttctagctttttcctgttctgagcttcgatgatgattttgaaattctcactggaccgactctttcaataggatttgatgtatccaatttcaaagctatctagtgttatagagctatcatattagatattacctgtctcttattagcttggataagaggaaaccacagtaagacaacattcgagatggtatgtgcaagtgagtcgtatggagcgtgtgaacgaactgcaagaaatagagcatataacgaagaaaatggatgacttttgagaatgcatggatagatagcctacaaacaatatttgagcaaaccgttcggcgaggaaactcttcaacattatcggtattgtaatgcacaagtcaataaccaaatttgtggcaagatagatggtctaacgacagttatttttcgatggacgtataggaaacgtttgacatctagagtgtagaggagaaagacaagaacaactatgataacaggcttaagataccataatttccttttgaatttggaaacctgaattaaaagcttctgcggaacacctttcgttgaatattctatcctgcatatttatgctcttctacatctcctaaggagatgtccgaaataattggactgcagttctgaaacaggacaactatatgagtagtgtggtattggttttaatatgaacaatttttactaacaatagacatcatttcgatggcatttttatttaggccggtattaaagcttacgaattgagaaccaagtccaaggaccaattggaacaacaattggttgaattgaagaaggaattggccgaattgaaggttcaaaaattgtccagaccatctttgccaaaaatcaacactgtcagaaagaacattgctcgtgtcttgactgttatctctcaaaaccaaagacaagctgtcagagaattgtacaagggtaagaagtaccaaccaaaggacttgagagccaagaagaccagagctttgagaagagctttgaccaaattcgaagcttcccaagttactgaaaagcaaagaaagaagcaaattgctttcccacaaagaaagtatgctatcaaggcttaagaaaccgttcttcctattacattattaagaacgttttttcatgttaaattagtttacatctttctacataatctctaacatcattgttgtatttgagtacacgcattttgcaaaatagacacagggtttctgtttaatctcatgttagaatgatcctctgcatggaatcgaacgccacttgctgtgtcactttaagattatattgacgaaattttttacctacatacttattttagtggggtatgctattctttcttcgaacgcttagattttctgaattccaagattttctccttcaactccacgttgggtataacctcctcaagtttcaatggtgatctgttgaaggggtctgttgagtcgcttagcaaatgtgctttaatggtgcttctatcaatggtaactttggaagtagggagaatgactgggtctttcatgatagtatacattaaaggatccaagaattcttctggagcatctcccatttccaagtcttcttcttcctccaggagtctagttttttcagcggagtcggcaaaatatatcaacttgtggcacatttcctcagaaaataggccagttttcactgagaggatatgtacagccttcttaaacaactctttattgaaggaacggccatctctagcaactgcagcaatgaattcttgttcatcagctaaattgatgtaaattgtagccaatgtctgtaacaaagtcttgggattgaattgatatttcgatggatccttgacttttaattcacgacacttggagcctactaacgactccaaattgtagtctagcatcgcagccaatctgtctacaatttccggtgtggaaaaagcttttggaatatgcttcgtgaaaatattgaacaacactaacgacttttccgacaatccgcatgacgacttggcttgtctttcagcggatttgagacgattttgtagctcttgggtttcttcttcccgacttggcggcaaaccctttgcccgattttctaactctagctgtatattatggacatcagcaagtgtagtaagaccttcatccaacaagaatgtcaaatcattcaacattcttgctacaaatctaacaaagaaatcagaattattttgtgattgccacagtaattgattgcggtagtgaggaatctcgtacaaagcttcaagaattattgagatactgtaacgggcattaaatttatcgtaaaactgtgatgaagaacctgtcttttcaacaataacataaaagtccaataagccatacaacaagtttttcaacacaatatcgttatgctcaaagatttccatcatgaaacctggagaattatcactcattggcatagctccgatacttaacacttgaaccattttacccttcaaatgaggattcgatattaattcaggacagcgtaaaatcatcgttgccaattcaatgtaagaatggagtcttgggtttctgaatagtggattttgcacatattttgtcacgtactggcaatagttgattgaaccttcgatgacaaattctggataatatttaaagggaactggggcgtttttcctcaaatactccgcgttatcgacattttcaactcctatttgatcaggtattagaggcaagtctatcgttttgaaaggatattggtgatacgggtcgataacacgcatcaagaaagtacttgctccggctatgaaatcaaagacctctaggtgcacagttttattactgaaaaatccttggcaagaagatctgaccgatgagagatggtgatatcttttctctaattgcttcaattgaatttctccaaatctggccatcatgctgttttgtgaattattaataacttgtcttaaatgagtcaaatgttcttttagttttgtgacttctggagcatatctctcatcaaatagtatagtaccaccaataccataatgcaagtacgtcaaagtcaaaaagaaacaatgcgaaataaaatttggctcctcttcatttgttttcttattctgatcataaaattcgtccgcctctttggcatccgagttcattcttgtttcctggttcaagtcaatgtaaagattcaaattgttgaaataattaacgtcaattttgtcaatcttcttgtaagatacatcgaggaacggcaaggaaaatttaattaacattaaagttatatttgtcataaaggagttggaagctaatttgttaacttgtgcatgatcacctctacgaagatggttcttattcacaatctgtcctagataggataaaagatctgacctcgattccggtgatgctctaatgattttatccacaatatagaataatctttgtagaaccacgttatgttccgtgtgcaaagaagtgtgaatcatgtttatctgttgctgattttgagaatcagggtcaacataatttttcaatgcgactgcagtctgaagtggcgagagggaaagtatgggacccaacaaagtcactttctcgtattgattagcagcggtagaatagtcagcaaagaatccggtcaatttggtaaatatggttgccactggtttgaacgatacaaatagctcgaaaagagtcaagactttattgtataacgtagagttgttcaaatcgaatccttctgttgcatcgaccttaccaatataaacttgcacagtctgaaaaaagttatcaacaaaatcaaaagcagttccctcctggattgatctattgatcattgcagttaacaaatctgtgaacttatccaaatcttgtaatatatcagaaatatactgttggaaagagcccttaattgcaaattcttcgatctggaaacaaactaaagcataacccacgataagcctatcaatctcttgtaaggtaatagtttgctgttcatccagattctttttcgatatacgtttggattgctgacaacgctggaaacatgagtttaaatatttcaacggctgttcttgtaacgactcattttcggtcaattgatacaaaacaatgggatcaacacagtctgcactaaggtcagatacatcttctatatctccaacataagtgcaccctttggaatcattcgggtcaagggtcaccataaaaatgtctctcattaacgtcattctgataaatcaaactgaatcaaaatgaaaccctaggacctgatgaatactttcactatacctaacagcacgcttttcgtgtaatagacgagcgttataccaaatttataaaatttggtcttatagacttgattttcgccgtctactccactagattccctatgagtattttcgttaatagcatattgattaattgataagtgtatatttagataactttatatcagtaatttctccgtcttagtaaaccgcttgtatcagcgtatttttcggcccccgaaaattaaatttctggggtccgaataaatctgtctcaattggttccgacaggaatgcacccttcttcaccagaaacgctgcgtggtactggattgtgaaggaatcgatcccacgtcgacttaatcactacattgcctccatccaaaagacggggtatcctctctgtttcaattgaataatgcacctttcttacgcagtgtcagttaacatctgttccttcttttatgattcgcaattgcaacacgcgcatgcatacttcaccattggcacatgacgagcagtattatttaaatacacaactatttcaactaaattttgattcattcgttgccatatcaaaaatatcaagtttgttttcccttatccatagatcatatctaacagaaacaaggttcatctttcacacttcttacatagatacaacggagtacaattcagtaaaaattactgaacgccattatttcaagaattgactgcatcattactagtctgagtaacatcacatatagaaatcttcaacacctttttttgtaggtttatcctaaatcccttcctctatttgtctcatactctggccaaatttttttcccttcgttcctaccttactttcaagaagctaatattaggtattggtatttcggaacaaaatagattaaagatctacaagatatacagccattggttgaagttaacgaggggtattctgccaacaacgtaattgaattatcaccactgagtgactctaccgatagtgtaccatataacgactttttggaaagaggattgtaacatggaagagcttaaagttacgccggcattgctgatagcgttgtttcaaaaacctcaggatcgagtgtttttgattgatctggagaatagcgttctagattttgttgaatcctcagcttatacttatcaattgaaaccaatgaactcttattatagattactgtcgcatcaagtagcagaataccatggtttgcaacatacagtttcgaaggacaatgataaatgtgtgatcgtctataaacagaatgactatgaaccaaatgcaaatctgatccttctccaggaattggaaccacaggtcatgtaccagtttccaccagagtattacgcccttgcttcgatggcagcagctaataatcagcaacaattgatacacaagacaataagacaaaagccaagacagagtagtcagcatcatacgccagtgtcagctcctgaacacgtatcggataatcaaacaaccagagacaatgcacaggttactgatgataaaagtgctgaaggggtttcacctgcagcagcagctcttcgtatgtctatcaagaaaaaagtgaagatacttaaacgggaggtggaaacagatagcggacaatcgagggatttaagccacgaagcaactacttcaacatcaatagaaaacactttggaagaagaaaagggtgcagggtcaaataaagattcgacggtcatagatttagaggaacagagaagaataaaagaacaacagtataatgaagaaaaagagaagatcttctctggttctccatcgtccctcaccccagtttccaccccacctgcgacacctgtaacactgaattctgcaagtggatcgaatggggaagcagatgattctcctcagcctcatcagttcgagacttccagatttaatctaaaccatcaaaacgaaatgaaatatatgaagaaaacacaataccagcataacaacaagagacagaactcacacaataacaggtataacaagccattgaatagacagcctgttatgcatccatattatggagtgccacctccgatggcaccaatgagaccagattctattccgttcggatatcagatggtagcgccaatggagtatatgtactaccctataggagctccaatgactaacaatcgaatgatgataccaggacaaccaatgtatgccatgccaccaccagtatttcaaccttatgagaaaaagaacagtggtaaaaatgactctaatggatacaaaaagaatggaaaacccataaatgaagcacgtcattttcgttgctgaagcaaataaaagttagatctaatcatagacgtatataatgcgattacaaacataatggtttttacttgttcatattgaaatgtttcagcttttagagaacgccagctacgttgttcagaagatgggcccgggcaatgactagcctggacatgaacattacttcgtcactaaagattcatccacaatcaatgtctgatcaatggcgaaaatattgtcacagcttagagtatgtatcataaatcatcaccttttcacaatttcaacaccccaattcaaagtcaaatggttgttcttatcatcatctatgaactttgagactgcagaataattcccgcgaacaaggaaaccacttggcgcttcagattcaggcaattccacctcataaaatgggttctttgtggtatttggagcatacgaacccaagtggtcatcaatcttatcaactgcaatgcctgcctttttggtgtattgcacgtatcttaagccagtaataatttcgtgttgaaccttgaaagtgatcttcaaatggtaaatagatttttctttgatcttgtatctctttgaggccaggtctttcaaagtcttctcgtttgtcaaatcaaacgtaattggcgctggttctgtgtcaacgatcaactgaatcttctggatcaccacacgacgttcatccccaggatgttccaatggtaaaacatcacctcccaatcctaaagaatctttccattttcttaacgcctcatcatcagcatctaagtttttgtattcttctacagtcttcttctccccgactttgtatgtatcgttttcttcatcgaattgtttaaactcctcttcttcagacatggctagaaacggtcacggcaactcacgaatgatatcactgagagtggatccaatgtttgattaaaaagatttaaagtataaagcgagaactttaatggcgttggatcaactctaacgcccaagctatcaaattgccaatattttgcatgtgttcttacacagtgtcaaagtccgctcgagatctgatgtcgttagttaagaaacctcaaatagttgcacttcgagactcgacacgcatcagtgaaaagaacgaagtaaaaataggaaaaccattgacagcacgtgacttgaaaatcacggggatctccgcacgtctaatcacttcacactcgcccttaatgatacatggaaatcctatcacaattcacatcacaactgatcaaacacagtatatatatatatagatatattaataaagaaacatgtttgtatgctagttcattcgacagctttatcctgacatttccgattacgtgaagagcctaatcgaataaactggtttcaacgaagagcgtatcaacgttacctgcaaatatgacaagattgcccagtatcgatgaattcaaaagctcatcacttaatgaacaaattgatattctagacgtattgtttgaacacagtgattctttagtatggttcactctccaaaattctcgattcatggctagtggatggaattcttacgtggaactcgtcaacgccattaaggataaattattgaaagtgtgcgacgatacagaggcagaaggaattagcagccgtggtgtagatcatctggctaacatagtgggtgctcatccaagactcggagattcaaaacagaaactgtctgtccattccatgaaagagcaagccaacttaactggtagcacagtcgattctttagaaattttgacatggttaaagactttgaatgacaagtacgaaaagaaatatgaggggttgaagtttgtagtctttgtaaatggcagatcttacgatagaattagtaaactgatggagcaaagaatcaattccaataatacgtggttcgaagagtgtaggatagccatcaacgagatgacagatatcgccattgacagacttaacaaatgcagtgaaattaagggcaagatataatattccaaaaacgaaaggtaaataataacacttgaagcaactatagtttttctgattcattgcgagggcagcgttacattctccaaatatatcatacttgccatgatatatataaacattttgtgccttctgatcgaaaaaaacccgaatcgatgtaattaatagtattgatgatatatatttattataacagacgttatgtattcagtgataccacattacgagcatttagatcatgtctccgtgtacgttccaaaaaatgatattgctagtgaggaacataggcgggatggcaacatttcgtagaatacctataacctatgaaacaatcttttcctgatagataagatcccagtgaattacaagaaataatccggagtctttctacttacggttggttcaccgggtcttacggatggattatactgtaagaactgtctattcatcgtatcgtcaacttccatgattgctgcttgattaccacatctataacagtagtttggagcgctgaatatggtaacaacactttgttgatgagaccaagcatatccttccataaccaattgatgtgctctcgcaatcaatgagagatcgtttgtatgattgaattgctcactaatgtcttgaccaaacgtgaaacctgcacctcttggacttataccccagccacctctatcatccgggtctgaccataatagatcacacattggaccttcatgaggaacctcttgtattctatttagttctctgacttgatcaaccgtttcgatcattggtgaaaggccaccatgtagacagaagatcttgttatccactagtgcggtaattgggaaataatcaaacaaatcagtaaacattttccaaacgttagcgctaccgtatttccttagacactcatcataaaacccgtacacttgtgtaatctgcctagactcatgattacctcttagaattgtaattctgcttgggtaacggacttttagtgcaaccaaatatgaaacagtctctacagaataataacctctatcgacataatcacccatgaacaagtaatttgtatcgggacaaggtccaccgatcttgaataattctatcaaatcgtggaattgtccatgaacgtcaccacatatcgtcacggggacggacacaggttgaacgttgtcctcaaattgaagcacatcaaccgccatcttacacaacttggcaacatcttcctccgacaaacattgacattgactcaacttttctaaccatgcatccaattgaccgatactagacccagtcagttccacgggtttcgtagccttattgtcagctattcctgacgtacctggagacgaactcgccaatccgttatcaaaacctggagcttcttcgtctaaagttgaatccagttgatcttctactgcgtcatgcataggcacatcagtatcaacatccattatgtaatgcagtaatgttttgaatgtgttaacccaactcttttattctagccgctggtatattagtaacaaataagggtttactccagtctatatgcacgctttgtcaaacgcctttgccaaacacttccaaatggtccgttctttcttcaattattatttataaccttcttttcctaatttctcaaaatattgggagaaagaaagtagggaaaaaaaattaaatcaacagagaacaacaacgcactcacagaggacgacgttgtattagataggacacaactgagttcaaattgttccggctcaaaaaatcacttggcctcagaagtggttgatataaatgaaagtttagtgagattctaccgttaactgaacctggtatcgctaacaatttcgtaaagagtacgtatactttgtatatacttttttcttcctatctttcttccttttttgtatggcattttttttgctcttccatactgtgtagggaagatcggaacacagatagttacagaacgggagatctggcgagagggcgatacttccatattacttaagcggccaattttagggtctcaaagacaagagcatcacgcacgactgtatcagttgaaagtaagctgtctgaaaacatcattgttttacttttacttccacagggaaggctgggttccctttgtagtatgtaatattcttccgttgaaggcggtagggtaactatatatcagttcctgtgtcacacagatgtcagcgattcttggatttagatataaactgaacatggctccttctgtggattcgagactgtatcattgaaatacatttcacttgttataagtgaacgattacgttcggtggtctttcaaatcccccaaaggttacaaacaatgacggagactttagatcttagcaatagtcggtgggtattcgatcaaagcctgttacaaggtgatgcgcaacatgcagaaaaatctcagggtcaaaacttgcaccattctgaaaaatctgttagggagttggttatttctaaacaacatactcgtgttttccctgtggataaccaattaatgggccggatggaggatcaattagttcgatggaaacgaccagcatcctcgcatcttggcacagtacaagtaatcgagggcactcatccataccaacaggaacctatttcaatgtcacaaacgtggtcccagataagagatgcattttcgacaagaatgcagagaaatagtatcaatgatacacaagaggatgaagaagaagatttagatgggcttgacttgggcaataccgaaatttggaattacaaagacaaagcatttactactgaacgtattgacacctaccgttccaacattatcgatgaatacaatgcaacaacgtcaatgactgcaaaagccgtacccgtaacgttgaaattaccagcaagaacagatgatatgacgataaatagtcagtacacgtatcactacccaattccacagtactacctaccacattcacaacaacagcaaaacaacaacaatgtaacaaactctagacaaatgacgcaggcttctcaagatgcatccttctcttgctccagttggttatgttttacttgagtgagattcgtataaaactgacgcgcgtcaaaaaaaaagacgaaccatgtgattaactttcatagacaatgaaacagtttagaaaactggaaaaaaacgcaagattaaaaagttcaaaggaatttaggctaatatttataatcagtaagtatcgatctcaggcacctttaaatacaattggtaacagatggcgattaatactaaaaagatcaaacggttcatattctttcaccttgttgtatttcaatttttcatcgttgacttttcaaattctgaaaagttaccctgatagaattgataaggggcaaactgtgctgataacactagtatgaaaaaagattgaaattaagaatttgaacttaaaaggaaaccattatatgaatgagcgcgtggtttgagtattgaaataaatcctgtagaacaacgttcattaactagttcatcgatactgaccttaagataataatatcctcggaacaattgacattgagatttgtacctaacattacgtgggtatcttcctctattatttttctttctttctttcttacagttaataacgttttcaattaagagtaattgattgattggttgattaattagctaatttaaagaagttattagggcgtgcaagtttagaactacagatatcaaaaatggcaggtgcattggaaaacgcacgtaaggaattgaaaagagtaacccttgaagaccatgaggagagtgaatatggtgctatttactctgtttctggtcctgtggtgattgcagaaaacatgattggatgtgccatgtacgaattggttaaagttggtcatgacaacttggtgggtgaagtcattcgtattgatggtgaaaaggctacaatccaagtgtatgaagaaactacaggtgttactgttggtgaccctgttttaagaactggtaaaccattatctgtcgaattgggtccaggtttgatggagacaatttatgatggtattcaaagaccattgaaggccattaaggatatctctcaatctatctatattccaagaggtattgatgctccagctttgagtagaactatcaaatggcaatttactcctggcaagttcaaagtaggcgaccatatctcaggtggtgatattttcggttccattttcgaaaactctcttttggatgaccacaagatcttgttgccaccaagagcaagaggtactgttacatggattgcttccgctggtgaatacaccgttgatgaaaagattctagaattggaatttgacggtgtcaaatacgattactccatgtatcacacatggccagtgcgtgttccaagacctgtcaccgaaaagctctctgctgactatcctttactcaccggtcaaagagtcttggactctttgttcccatgtgttcaaggtggtaccacctgtattccaggtgcttttggttgtggtaagactgttatttctcaatcattgtctaagtactccaactctgatgcaatcatttacgttggttgtttctctaagggcactgaagtaatgatgggtgacggtaaggatgaattgatagagaacattcaggtaggcgatgaagtaatgggtagagatggacttccaagacaagttgttggcttaccaagaggtcatgatgacatgtaccaagttaccgaaaaatcagaggacaatgaaaccgccaagattagtttccaatgtaacagctcacacaagctagttcttgtcactccacaagatataagactaacagagtctaaggaaaaggttaccgttgcattcaacagattggcagacatttcagtgggaaatggtactgaatcacgcactgttagactagttgaaagagctgaaaaatcttttgctaatgctgaaagtaatcaagctatcataaatgctgctgaatttgtcactactattgacacgacatccattgaatggactttggaggccagggatatgttgttggtagactcttccatccgtgaagtaactcaacagttgataaaccctgtgttgttggagaaggaacacttagcaggcgtcttaaaatcaaacgatttccaatcttctttggctccacaattttcgtatctgttgggtgctttcgttggctcctccggtaaggacaactcagaatatcttcaacaactgtctgctcaattcgataaaaagattgttgccgaaaagtctatcgatgtgcaatctaatgggaagaccgttggcactgctagcattgttatttctcaagagccagttcaagaaaataaacgcagaaaggtcgctcaagtcagtcttgtctccaagatcgttcaagaatctttctctagcggcatcccatcgttcatgatgtccgaaaacatcaatgttcgtgaaagtttcttggcaggtattgtagactctcaaaaccaaaagctagatgacacagtcgctctaaaaacactatcagtcaagacacatgacggtattgcgagattggcgcgttctttaggtatccgcgtttccggtaagaaacaaaaccaagaatacacattgactctttcaggtgatgctttgaagagtgtttcaaattggacctccacttcgaacatcgaaaaggttgatgtaattcataaggctcaacctatctctttcgatttagaaaaaattgagtctgctgattattttggtgtcactttagctgaagaatcagaccacaaattcttactatcaaacatgactttggttcacaactgtggtgaaagaggtaacgaaatggctgaagttttgatggaattccctgaattattcacagaaattagtggtagaaaggaacctatcatgaaacgtaccacattagttgcaaacacttctaatatgcctgtcgctgctagagaggcctccatttacactggtattacattggctgaatacttcagagatcaaggtaagaacgtttctatgattgccgattcgtcttctagatgggctgaagctttgagagaaatttcaggtcgtttaggtgaaatgcctgctgatcaaggtttcccagcatacttgggtgctaagttggcctccttttacgaaagagctggtaaggctgttgctttaggttctccagaccgtattggttccgtttctattgttgccgctgtttccccagccggtggtgatttctccgatcctgttactacatcaactcttggtatcactcaagtgttttggggtttggacaaaaagttggctcaaagaaagcatttcccatccatcaatacttctgtttcttattccaaatatacaaatgtcttgaacaaatactacgaaaagaactatccagaattcccagtgttgagagatcgtatgaaggaaatcctttcgaacgctgaagaacttgaacaagttgtccaattggtcggtaaatctgctttatccgatggtgataagattaccttagatattgcttctttgatcaaagaagatttcttacaacaaaatggttactctacctacgatgcattctgtccaatttggaagacttatgatatgatgaaatcattcatctcttaccacgatgaagctcaaaaatctgtatcaaacggtgctaactgggcaaagctatctgaagcaacgcgtgatgtcaagcatgctgtctcttcatcgaaattttttgaaccaagtagaggtgaagaggaagttcatgcagaattcgagaaattgttgaccaatattcaagatagatttgctgaatcaaccgattgatcaaacctaagtaaattttcttatggttccgaccgcaccccatccttactttgtttcaccttttacaccctatataacatagaaattcttaaacaaagaaaacaattcaatgtttgagattatcatcaaaaaagaactaattaattaataaagtactttattttaaccacatcttgatactgaagacgaacagtccgacctgtaaggtcacaactatgtataaaaattaataaagtagcatttgaaaaagcggacttgaaatattgaattaatacataatagaagaaatacttaactattttttaccatacacgtattctacgctttcaaagccaagtatggatgaagacagtaattgattgaaatcaattgagcttaatacaatctgacaattgaacgcctagtgaattgatttaaaacgttgacgaaaaaagacatcctagagaaaattaggatcacaatagcaccaacaataccaataataattaggaaagggggctatgagaaaatcactttagaatagttcttattttccattcaaaacctttccaaacccaatatatcacaatttgcaacggatttattatagagactagatgagaaatcataaacgttaaaaaggcaggaaaaaccataatcacaattaaatagaaaccaacagcataagagcattgttcaatgcactcgccattgcgcaactaaatctttgcaattatctcgtaatgagaaaagttctttccctagtttattgattcagtccgcttatttggatctagctctcaccttccgtctctttctcttaagtcttctaactctcttctttctccacttagcacgcatttcggtgatgaaataggtttctaagttcttgactttctgagaatcaaaagagaatatatataacaaattacataaatacaactgcaacaagaataaactaaattagaaccagtgaatatatatatgattttggaattctcttcaaaaaatcaaagtgttaggaagaaagcatccatatttaatttgtaccaaatccttaccaaggtttttttttgcaaatattatgtttggtggtaatttttcactcaaaaaaaagtgagcaattctctacggttgtgtatggaaagcgggtgagcaaggagtttcagtgcgggtaacaatatacatgttaaagcaaatgagggcacacaggttaagtacgtaaaacaggtcaaaatagcctcatttcgaagccgtaaaaaaaccttatagtcaaaacggtcaatctgcagtcagtggtggtgatctttggatcttattggcttgttattggtgcctcttttggtatgtaagtgatttatcagggccaacccttatatcttgaagctttgggttgggtattcgatttcctatttcggtattataataaactctttgattgtccgattgaccaaatttgggtgtaagggtgtttaactggtgtatgggtgtaagcagtcctaagttcttcggatgtctagcatgtttggcatattattcggtcatgtccctttgtcacttcggttatttatttcctatgtgaatgcactataaatatatataaatatatcatcatataatcatatatgacgcatcactagtttcatttgtggacggactcttgtcgtattgcttttcttaaatcagttgacatctcatgaatttctaaactatctaagactctgtctaaatcatgttccgaaagtaataacttttctccatcggattcatgcttttccttcttgctttcctttaaaatgtcagaatactgttccaggttgataaactcgaacttttgttcctcgctagtgattaatgactccaaatgtttggctccgaaatatgccttcaaattgcaatataatctgtaagttaaatatattcctggtacgttgggaaccacaggtattagaatcaatggtaaagaaatcggaatcccaagggcacagagaagtgcgtgtttcttatgatattgttgaccttttttcgaaagttgtttcaactgtgctataatggtgctttcatccaccacactcctggggaaatatacatgaatcggctttggtttcaaagaaattactgaatcgtcatttttggccttaacgtactcgtttaaggtaacattatccttggtcccattttcaatctgtttcaaaatataagattcagaagggatggttcgtaatgaattctccgtccatggaatttgatccaacagtttcgttacggttgaaactatctttttattataacttttttgggaagcttgcactgaataccaaagattagcagctttctgggaaagtttggtttcgtacctgataagtgctgattctttattcagtaattcattagaatatttgaaataaataaacgattgcttgtttgtgatcggtatcactaataacttcacgggatcgttaacgtactgttgtatagttgaactcttgttataagcctttgaatatgctgaaaatgaacgaattttaatcatcaattaattatgcaggttgagaacgggagggagctgttgccagattttcgtttgtggagctgtccgaggtctcccgtgtcacagctgtcagatgttttacagaaataaaagattagttgtttatcggtgctactgttccatccataagtttaaagttccggacctttaaaattactacgttaaataataaaagtcgaatccttactatgttgaaattgctatgaaccatgaatgaatatgcaaaaaagaagaaactataaatttggatgatattataagcgaactaacacatatcgggtcaattgaaaggtatcgacatgatcaagatgcaaccaatcgagtcgctagacgctgtaataagcgcagcgaaagatattttattgaatgcgagttcatttagaacgttttgtaatagtttttagtatattctttttcggcatcccaaatcctgtgttttttgggacgaaattgctgtcaattgtcatgaatcttaaaagatatgacattctgtcaaagtgcacttttgtgaatcctttgcattgtgagctctgatgaaagttagccattgccctctcgaatagatgtgctagctctaaagggcattatttttgcatgcacatactggaatacaagtggcgataatcaagtgcacgctctgctgttttaggtgacgttcactgttatcgagcactcaaaaaaagttgaaggttccgtgtacgtcattgcggcaagattttgttcgaatctcattagtggaataggagatacatttgatcacaattaagcaaacaatcgtttgcagttacaatgacttctgatggtataaatcatttagctgtgccgaaagagagtaatgggaaaatctcaagagtttctaccaagaattctaaggattcgctgtcgactgatgtatcaaatgctgattcgaagcagtatcctgagatcttgaatgcatattcgttgtatccccgtactgtccctcccttcgcagtggatacatgtgctaatagtggctcaaaacagtatcctaaacgaagtgaatgcgatcagatgttcaaggatacgttcttaatgtcgcattcagataaatggagtgaatttcttcaaaatgccggtagcaatccttcatacacttcaagaattattcttgacaaacccaagacagaatcaagtggtgctggcaccagaggacaatctacaatagtcagtaattcgtcgtcttccttaggtaagaatgttgacgaaaaggaaatcaaggggcatggaatagttgtcgatgaggaaactaataaacatacagatacgcatgcagtggataccgaagatggaactgcatactactatggacacacgacagatagcagttatgatgaggaagtagaaagagtcagacaagaaatctttcaaaatttagatggagattgggaaggtgggaaacgattggatgctatcttcaacgctccgattcctgaaagctacgaattgagtaatcaacgagacaagaatgagtggcttaaatacgtttcccaactcaaagctttttactacttgaataaggactctgcgaaacaatcttcggaaactcattcaagtgacgatgggaggtttcattctattttaaacaaggggagaaatagtgtgaatagtaagaaaaactcttgggctacccttgaacaaagaaaaaaacaacaatggttaccaagactacgaagacttttattgcaaagtcaatatctacctttgtcgttgagatttctcattgtgatactctgcataatctctcttggcctagcaagtagaatataccagaactcggattccactgtcgaatccttcgaatcatcaatacctcaacaaccaagtactatcatggcgctatgtgttaattccatcgctatattatatttggtttatatcggatatgacgaattttcagggaaaccgctaggaattagagatcctatgactaaagtcagactaattatgctggaccttttattcatcatattttcaagtgctaatttatcgcttaccttcaatacattatatgataatcgatgggtctgcacatctactggaacgtcacaagttgatcctccgcacgtaggatatatatgtgacaaacaaagggcgctcgcggcgttccttttcttggtcttggtcacttgggttgtaacgttcagtattagcatattaagggtcgtggaaagagtcagttctggtgctccaagaccctaagactattcttgaaacgggcccttccgacttaagacgcctgtagattaattgttttaaataaatcattattccatgagagtacataatttgtttacaaacccaacaaaagaaaatcaaaagtaccaaagaaaaccttataaacatataagtttgggccctgtattaaacaacataattagacgactgcagtatgctaaagtatatttgccgaaagctgtaatccttaccctcttttaagtactttaataataagatcagattcatattgaggaacaattcaggattttttgatattccaataatgtgtggcaaacgaaaacaaaaatataagaaattatagtaacatagtatgcaattatataaatcagtatataacaagtaaggctgtcaaaaagggtcaaaatatcgaacaactcggagatacttcacgatagaagcaatataaagttttcctgtgtgacccttttttataggatcccgccaacaagtggtgcatttcatatttagcagtgaaggcgctttctattctgttttatcctttctttcgattcattgaaaagggttgctcgactaattgggactcgaactgtattttctatcgctgctgatttcagtttactaccaaatctttatttacaagtaccgctacctgcgcccttgggaatactattattctaaagcgtatatttaactgggttagtgggaagcaagtctcattaacgcttcagaaaagataacttaggcatcgttcaatagaaatattactggtaaaagaaactacacgtgcaatcaataagaaacaagtctaataagctatggcagacacattacctagatcagatgatttggaagcaacatggaactttgtgaagcctgggatcgaccagatcttggatcgtgatggtacatcggatataaagacaaacagagttcagaaagttctttccccaaggatgtacatggaggtatacacggcgatttataattactgtgtcaacaagtcacgttctacaggtcatttccaatctgatattatagggaagcaaatgaatcaatcttcgattcttgttggaggagaaatctatgagaacttaaagaattatttgaaagattacatatcgaatttaaagaaagatgataatgtaacgtttttgaatttctacgtgagacgctgggaaagatttacaatcggagctattttcttaaatcgggtcttcgactatatgaaccgttactgggtgcaaaaggaaagaagcgatggtaaaagacacattttcgatgcacatactttgtgcttgatgacgtggaaagaagttatgtttgaaacacataagacggaactcgttactgaaatattcgatcaattggatttgcagcggaggggtgaattagtgaataaatctgctattacaatagcaataaaatcctttgtgatattaggtatcgatccatcagacttaaagaagttgaatttgaatgtgtatattcaaaacttcgaacagccattcctacagaagacaaaagaatactacacgaagatgtccaacgaattcttagactctcacagtgtctctgaatacatcgaaaaggcaaatgaatgcataatcttcgaagaaaaggacatgattttatatttggattcccatacatcggcaccattgtctacagctttgaaccaagttttgattgctgatcatgccgataagttaaaaaaagagtttattttacttttggataagcaagatcaaagattgattaagctcatatacgaattgatgaaacgcgattaccgaatgttaccagatttggtggatacttttgatatgtacatcaagagagtcggaaatgaagaaatcgataaattaattgatgcacataataagagtgcagcacaagattcaaacgctaaaaggcaaccgggattatcacctagagattacttgaaatgtttaataggagtttacaaactcttttacaatatcaccatagaatgttttgaaaatcatcctgcttttgctaaggctttagactatggatgccgttgcttcattaacaataactcattcgctattcctcctggttcacctaaatttgcgacttctagagctcctgagatgttggcgaaatacagtgaccagttgctcaaaaagtcgaccaagaataatgaacaggtagatttgaccgtggatgatatcatgactgtctttaagttcttggccgacaaggatgcatttgagatgcattaccgaaaaaatttagcaaaaagattaattcatggatcatcaaaatcagaagctgatgaagaaatcattatccaaagactacagtccgagaacagtcttgaatacaccagcaagattaccaagatgctacaagatgtcaaattatctaaaaacttgcatgatgaattttccacgttcatttcacaagatgggaataatactactagcgccgcaactttcagaagcaaagttcctgaattagaacctctaattcttgcagacaatgtatggcccttcagctatcaaccaacagaattcgcattaccaccagttcttgaacatagtaagaacaaattggaaaccatgtatactgacaagcattctggtagaatattgaaatggctatggccaatgtctcgtggtgaaatcaaggcacatattggtaaaccaggcaaaccaccattccaattcactgtgactattttccaaatggcgattcttaccttgtttaatgatatatctacgttgacctttgaacaaatacaagagagaaccaatttgaaggctacacagattgcgtctaatatgtatccgtttgtgaagatgaaactattaatacaatctccagaaggggtggaaagtatgatcaagttagatacaaagtacaccttaaacaaaccctatcgattatcgaaaactagtgttaattttgcagccgctgtgaaaaatgatctaacctttactgcaaccgttaatggatctgcattagatgaaacagaggcatctgagcaaaagaaagcagaaaaggaactaaatcaacaaagattgatgttcttaagagcatgcatagtgagaattatgaaggcaaagagaaaactaccacacagttcattgatgaacgagtgtattgccgaatctcaacagagattcaacgccaaggtgtccatgatcaaaaaagctgtcgacaatctaatagaacaagagtatttgaaaaggacagacgacggtgaatgctatgaatatctagcgtaaacgctcacttttttatccaccttttacttcgccatacatatgtataagaaatgtatatgtatcaacatatatttcgcaaccattcgaccattcgaccaaaggtcaaccttgggccccatattttcaagcatgaatattcccaagaaaaaaagagagacatcatgaaaggaccgacgagtatactattcattactcaatagccaaacctaaatgcttgggtagccctctctgctctcttgctgctctcactactctcagtgactaccttagcatcattcggaaggtgtttgtcaatacctgctgcaaaaatctacgttcatcggatttaaaatccacaggaatattcacgaaaattggtcatgattagactttagctcgaaattgagtgggaattttaccatatttcttttcattgaccatatttcaattatgggaaagaaaaaattcagatttcagatgagtcaagccatatcaaggcagtttcgatgacatgaatgagtctgaaaaaaaaaaaaggaactgctctacatttgatggcaggtgtttctttgtctagtttatatgctctcaggttcgactgttttgtttgtgtgatcgattcttgttacaacttaataatatttttgtgatattattttttattggagctatatattatactatatatatatatatttggattacattcatttcatttctcttagagtattataaggcagaataggagaatatttccatttgaagagcaaaaaaagtagataaactagcgatagacaataacaaatcatgagtagcaatcaggatttccaaccagtgactgaatctgcatcaagtgtgacaaaatttcaacaaaatccatacggtccaaacccagctgattatttatcaaatgttaacaactatcagttgatcgattctacattaagagaaggtgaacaatttgccaacgcctttttcgatactgaaaagaagatcgagattgccaaggccctagatgactttggtgttgattatattgaacttacttctcctgtcgcatctgaacaatctagaagagattgtgaagccatttgcaagcttggattgaaggcaaagattttgacccatatccgttgtcacatggacgatgctagagtggcagtagaaactggtgttgatggtgttgatgttgttatcggtacttccaagtttttgagacaatattctcacggtaaggacatgaattacattgccaagtctgctattgaagtcattgaatttgtcaaatccaagggtattgaaatcagattctcttctgaggattctttcagatcggatttggtcgatttgctaaacatttacaagactgtcgataagattggtgttaacagagttggtattgctgataccgtcggatgtgctaatccaagacaagtttacgaattggtcagaacattgaagagtgtggtttcatgtgatatcgaatgccatttccacaacgacaccggttgtgctattgcaaacgcttacacagcattagaaggtggtgcaagacttatcgatgtcgctgtattaggtatcggtgagagaaatggtatcactcctctaggtgggctaatggctagaatgattgttgcagctccagagtacaccaaatctaagtacaaattgcataagatcagagatatcgaaaacttgattgctgaagccgtggaggtaaatatcccattcaacaacccaattacaggattctgtgccttcacacataaagctggtattcatgctaaggccatcttggctaacccatctacatacgaaatcttggaccctcacgatttcggtatgaagagatacatccatttcgctaacaggcttaccggttggaacgctatcaagtcacgtgttgatcaattaaacttgaacttgacagatgatcaagtcaaagaagttaccgctaagattaagaagcttggtgacatcagacccctaaatatcgatgatgtcgactccatcatcaaggacttccatgctgaagtatctacgccgcaattgagagctgtaagaagagatgacaacgacgtcaatgacattgatatccaagagccatccaacaagaaaaccaaggtagagtaaaccttaagaaaggaaataaacataaaagtactagaaagctcataagacaagtgtaacttcttctttttgcctcgttccaccaagtaccttgcttttattcacgtttatgtcaaactacatttctctcatccatatattaagtatcttagtaatttattatagtaactcaatctgacacgcacaataaaaggcgctcaaacacaggccgcaagaaataaaaacttgtgcagataacagacggctggtatatatgcttactctcatttcttttgatgtattttctctggagtaaaaacagatggaataagccgggaagcaggacatattccgttcaaaaagaaagaccccagttctgacatgagacactaataaatactaacagtaactaaatgggagcccgaatccaccgcaaccgacaagacattattaagggtccggaaggagacttgacactatgtcactactttcatcatatataacgccattcttccatcactaaattcaagcctccctaaccaatcaggttctttagtgttctctttttcacacacatttttttttgtcaaaaagtttcaccaaaaaaatgggaaaaaatataaaaggaaaagaagaacctagttccccttgaaacacacatgtcttaacgaagtgggcccggaactgaaggattgatcacataatttgcgtcagttacagttagactagataaaaagttttaacaaagaatacacaaaaccataacaaacaatgctatctcgttccacccgttccattttgacccgtgcctccaaggttcaaccagctgctctcagaatgtactcttcttctgaaggttctgtcggttctaccagatcagatggctcttctgatgctttcactaagagagaaaaggcacaagaagatttctatgtcaagcaacacgaaaaggaacaattggctcaattgagagaacaattgaagcaacaacaaaagaaaatcgataacttggaagagaaattggacaacattaccaaataaggagccctttttgttcgataaaaagcctttagaaatgaccagctgattcttcaaacaataaaactgacgtttgtttcaaaatatggagttaatcgctaagctgcgttgtctctgtcggatctaattcttattattacctttatttttttttgttatttgtcattatactccatacaaaatccaaacccaattcattaaacgccctttttcaaagaaaaaaacctttaaaatattctacaattcgatcaactaagctgtctgttgattaatgagatcaacccaatcgtagttaatgtttttttctacgcagtcaaattgagaattttattattgacgaaattatgaaaaccaagaaaatggatacagattttttttttatctatcatgtcagcttaaaaacgcccgttggtaagcgctcaaggaagaagtgtttacttgttcatcttcgccgttttacagttctttcttatggaagcgttgagtatatgcgtattggctcgcgtatgcgctgacaccacacgtaaagtttttggtaatattgaaaatgagattaaaaacaaaactataatcatgtaattcaattttaatatattaacattcattatactataattagaaatcaatttcactcaggattacacaatggaatgaacagtcagtcctaacctttcgtaggttgcttcacagtgatccaagggaaacactgaattgaaggaaagatattatttacagtaacttagtagaagttaccctttcgtggggaagtgagttcagtcctattgagatatctaaaattagtaatccgatatagtgtaacggctatcacaccacgctctcaccgtggagacccgggttcgactcccggtatcggagaaaaaattatcctttttttattatcacttttgcatgttataatatgtagctcgggactgttcatatggtgctgtcatgattgtgtgtaaaacccagtcatctcactttaaatttctcattataatatattctgttttttccattaatggaaataaatcccacttaacacccatacactacacccatattgacagttctgccctgagatacgcataaattatattgtatttctaccgagcttgacaacactttttggggccggtggtagttgaaacccgtgctatgggatattctgacgattggcaacacgtagctgttcctgttttaagtgttttagtgtctcttacatctatggcgttgtcttgtacatcttcttctgtgtaaacttaccctcccttgttgtcgtttttggatcaacaaaacttcaaatcttgttcagttttccagattttctgaattttcaccgaataatatttttcactggaaaactagctagatttcaataagatattgaacgtttaattatacaacacgtatttattgataagttgtagttaggttgtttgttgaggttcaattgcttgttgttgcgattttgctatagatccacatatacacatcatacctaactagcaatgtctgacgctgttatttcttacgcctctttgatcttggctgatgccggtttggatgtcactgccgacaacttgttgactttgaccaaggctgccggtgcctctatcgacaacgtgtgggctgaaaccttcgctaaggctttggaaggtaaggacatcaaggaaatcttgtccggtttccacgccgctggtccagctgctccagctgctggtgccggtgctgcttctggtgactctgaagctgctgctgaagaagctccagaatctgaaaaggaagaatctgacgatgacatgggtttcggtttgttcgattaaacgtcaaaatataaaaaacaaataaaacaattcaacacattttctcaaggagcattcctccctccctcgaatttccttttagcgtcatattaatctattacttaccacaggtatcgtcatcatgaagaaatattagaaacacattggcaaaaatactggcagttgggacatactacactaataaacagagcatattttggtatctcatctactatctgtcgatacatcgaatatcgattttctcggaattggtacagttttttggatatgtcatttcatgtgtatatataatttgtattcgtatttcttctagatatatatcatctgtttggaatggaccatatcagactttgtggagtgtttttgattccttaatattttttgcgttataatatatatgagatatgcctgtgtacctacatctgtacagaaatccccttctttcgaattggaccctgtgcgaactttactgtgtagaactctatgttaagctttcttccattgttaaatatacgtctgccgaattgacatctgaacaaaaagaaaaatgataagaatcacccgtaaactagtgaagataatataggtttctaggtcacgtattcagttcgttagcctgtaattgaactatgcgtccgtatcccttaaacgtgcccatccttggctttgctatggtgctaatcggtcttatttctttttgaggctcaagcagaaagcactgctgctgggcaacgagaattttcttccaagaatttctttatttctgttacattagaattggaaaaaaaacaagatattgatatacataaaacttggacgtacatgaacggttttatccttgcgatgagtgaatacttacggaagtttgggactattgcatttgttcgtaagtgaaagtgagagaacttaatactacatatatcctaatagtaaggtctaaccttcctgctgaactttgtagcagaggtttaaagagaactgagaacaagtttaaaagcgagaagagcttaataagcttatcaagattttttatatcagagctctcggtcataggtcactgcgctccctttgagttttgaagagcagatgcgtacacttaggtcgaggagtgataaaagtgagtctacttgtaatagtgccagttcaagtgtggatacaagaggaagaatgcagacaataactccagaagaacctgggaagttagaatacgaactggatgcagcttctgctgcgggaaataataatgttaggtctagatcacagtcgatggcgctattgtcagatgaattgcagaccgaatatgacgtgctgcaggacaccgagcattcgttgagaaatactagactattagaattggatatagccaaagctgtttcggatctggaaaccatcgagcctcgcacagaggacactgtgagaataatagcgttattgaaccgatctctgtcggcgatatcgcactggtcattacaagcacaactatcccactgggaaaacagaaaggaaaaggatgaacgttttgcagttgaaaagaatctagtgaagaaagaagctgaatattttaagaataaacttcttgaaagtgaaaaattacaaaagcaaacgcaatcccaattagatttatcttccgaaacatctaaattggtcagcagcgctccaataacaggtggtagccctgccacagaggcaaccctactaagtccaagacgagtggtgaaacaacggaaaatagcatccccacgtcgtaacaacactcgcgctcatacaccagtctccactctcaagcttgtcgagaacaccaaaccacatcctaggttaaagagaaatttaaacgatcagacaaaccaagatctaataagagtctttcatttggagaaaggaagatagcatcatcccaaaattaataaaaggtaaaagcaaaaaagcatcttcatactgtatcattatttttttgttcttcattcaaccattgtatttttatttatatcgtgtctcattgaaatagacagtcggacttctaatcaaattgctaacaatatatcaggcataatctgtggaatgaaactcacttatttggacaatggacaatagaccccttttgaaactcggtgttttctgattcatatcccctcatgaacatctttcatctgaaataatatgttggtaccattatgactttcctctcacaataagctattcgcccattatgcaacgggtttaaccttaatcctgtttaattaaagacgcaactctatatccgatcttccaggcggaatgtggaaaacatcattttatttcattgtaataatcaaccactatattttgtattatgtataattccaaaaacaaacattaactaattaaacttcaattaccagttccattagattagctttgttagtagctgaaatcaatcttgtcttatttccattacacctgttctgctgatttgaaagtttctttaaatacatgctccattttgggcaggaatttcaacctgtaaaaaaaccatttgaagagccacacacagatcaagacacttcctgatcagagaaacagaattcattcatataactccaatatcgataggtacccggagacctgcttatattcagtactacaatttgccaaagcgcattcagtgattagttctttatagtcaacattttgtttgacatcatttaacgaagggattggttggtattattgcttaggggaagaatggcattattgagctatgcagcagatctttatatgcctcttttttgttcttcgagaacatcagtagtggtgctcaatttgatcaatttgttggcaatctattctttggtgtattggtcttcagattttcttcaagcaagatatgacgtgccagatatatttgtacctaattcgcaagattattttaggacatcgttgttggggtttctatcgccattcctgttgcacttcatcaaaagcttcctattcaacataaatccaagatatctggccgttgatatccttatcaatttcacttttaatgactggttcatgctcttgatcattttctctctagcatatcctcagttgcaagaatcgaaacccaatgaagaattggtaaatctcgtccgaaacaacggtcatataccaactgtatggcatattataccaaaacagtgctatatcttcggcatttcgtggtcctttagtgaagtaatcattagcgttatggagacgttgtacaattatgaggaagtaagttctatttcggaacaggacgcaaaagcaaaggcaacatctgctaattctgatagttccgaagacatcaggaaggaaattgaactagacaaatgtgtgagcgttagaatgctgagatcaaaaatttcaaagaatgtatataactctggatatggtgctacaaacgtaggaacaacgttatctaataacggttccgtaaatcaggactcgaattcggatgagtccagtatgattatcaatttcaacacagactcaatgaactttttaaaggatatagaaagccatggtaatgatctgaacacaagacatggaattccgttaaggccaagatcattttcctaccaacaattccctcacaggcaaatcaaaatgttccctcgcattcaaaactggaaggaactgataggaaaacttttgctttcaaacctcttacatctagactatatcgtgagcaatattggtcaatctttgctcatgtcaatttatttcatatacgttccaagccatccatcattgttcaccaaagtcgtgatatgtttcgggtcaaaaaccttcactaatttccttctttgcataataattccattcattacgttacatgtagtatatcatgttttcctatacacatggagagatctcgtgagtaacaatgtcgaaccatctgcgatacgtgcgcaaactcaaatgtcagactacacgtatggctccatcaggagtccactgatgttacaatcgtcaaacaatgttgcgtctgtttcatcaagccccgaaaatattctgctttaccattctattcacccacctgctgacactcagttccaaactgatgatggtaggctactgcgactttctcgtactatagtaacatattggcaatcgctagcatcgaagtcatggcttattccaatcggtctcaccgtgtggtcagtgactgtatttgtacttggaatcatggctactatcaaattcaacggttaaaatacgtagaatgtgggtagttcaacttataagaaccataccatggcaattagtctttaccgtaatgctgcagttaataccaaggacgatagtaatctgcccctctctatatgttatcatattcatattcaggcggtaaatcacgcatgtacagtttatgagagctagcttagttaaggatagaacaaaaaaactcttctgacctttcaacggtccgattttttagaagtacatttcctccgtactgcattcacttacttatttaaagtttcaatttggtacctcaggaagaggccttgagccttggcattttctgcactattgcttatgtttttcctaaaaagtataattaattgcatgaaaaagataaaaaatatcatgtctcttcaaggtctgaagtttgcgctgttttagaaggattaaattcattacacagcttctcatcctaagttcagctttagactttggtaaagttgcctgacatttctctgattttagccgagcaactggagttaaattcttttttgatcgaaccgttaaaaacaaggtgaaccctgattactttctgagagacagtctggtgtctatatttctgaacaattaactcaaaataccatggattcgtctgcacctttattgtcatctactggagccggtatccgcagatcctcttctgcgttggtaagatgtattgaagtttccaaagtagtgttccattcgtctccggtaaactatttgctcgtttttgttccgctaggattaatcttcggatatggacagttatctaccacctgggttttcgtattcaatttcatggccattatcccattagcagcaatcctagcctttgcaactgaacagctttctgaaaaggccggtagtaccttaggtgggttgttgaatgcaactctaggtaatgctgtcgagttgattgtctctatcattgctttgaaagagggccaaattagaattgttcaagcttcaatgcttggttctctattgtccaacctattattggtattgggattctgtttcttgttcggtggatataacagagttcagcagaaattcaaccagactgcagcacaaacgatgagttctttgttagccatttcaagtgcatcgttattgattcctgctgcgttcaaggccactttacctcacgataagggcacttctcatcttgttgatgataagattctgtcactatcaagatctacttccatcgtgctattggtcgtttacgtattgtttttgattttccaacttggttctcatcgtgtcatgttcgaagaacaaaccgaagaaactgaagaagtattgaacatccatcaacaacacgaacaaatttcagaatcaatgagtttgagatcctcgttgatcttcttagcaatcactactattctcgtgtccatctgtgccgatttcctcgttgggaccatcgatgacatcgtcgtgagtaccggtctatcgaaaactttcatcggtcttattgtgattccaatcgtcggcaatgcagcagagcacgtaacaagtgtcatcgttgccatgaaggacaaaatggacttggccctaagtgttgccattgggtcctcactacaaattgcccttttcgtgactccattcatggtactagtgggatgggccattgatgtgccaatgacattgaacttctctacattcgagaccgttattatgttggtttcggtgttcctatctaactacttgatcctcgatggtgaatccaattggatggaagggtccatgtcgctagccatgtatgcgctagtcgccttggcattcttctactacccagatgaacaggcagtgaattaaatgatcttcttatccgattattacttttcttcctttccctatcaaagcacaaggccccaaaaaccaaaaaaaaatctataaacactactcactaactctctccaagatgactagttcacatacatgaatcatacggtatatttccccgtaccgtgctgtgtatcaatttctaactattttctctgtatcataaagaaaactaccggtgtatagacaatctcaaaattactataaaactgaatttctcgaaaaccagcatttgctattttttcagttgttccttttcaaaattttcgctttttccaagttcatcagaatttcgcgagttccttaatttaaactatgaacacgaaaaagctggcagaaatttacttcattgcagggttttctatggatcgcaaagagtgaggttttctaaaaccagctattagaggttcaaagtgaaacatgaaacaacggatcgctgagaacttgggaaatggcgagcgatccgatcatggggcgatgcgttaatatgcgagcgatacttctataattatatgcgagcacatccatgtgtatatatatatatatacaacgagtgcgtattgaacttgtttcagtattgttttagtaggaactgtctgtatcaagcgatgggcaccagagaccatctcgagtagaagttgcacgcataaagtgataggaaatatgtcagaacaccaggcacttctgcagttcaataaacaggtggtaaatctggagatggttcattttttggccgctacaacagcgtcagtgatcagcatcaatgacaccgacgttcgccatggatctacggtgagcctggtagatttcattaaatcgttgatcaggcactctaacgtgcaaactccgacactgatggctactacagtctatttgactaaactgagatctattctacctcacgatgtatgcggaatcgaaaccactagacataggatatttatcggatgtttgatccttgcagcaaagaacctgaacgattcttccccattgaataaacactggactaattatacagatggtcttttcactttggaggatgtaaataccattgaaagagaactgctttcgctgtttagttggaacttgaattttagtatgcaggaattggtacaggcactttctcatttcttagtaccgatccaataccagttgagtaccaagaaatcgatacagaaccaaggtgccaacaaaaattgttcacatctgttattcaacgcaccagtgagtgggcaaacaaaaaatttcctcaatacagaagcgcattcaaggtcgtcatctcacatgtcgatcccctctttgtcttcatcgaacacattgtctacaatagactcgatggcttcttcgtcatcgtcactagcatattcatcatcttctggctcgtcctcatcttctggttcgtctttatcccaaagcaaactgaaagttatcagtgaggagccatccgcaaaggtcacaccaaggaagaaatttggtctaacgaagcctattatgttgaattctaagtcttgtacggactttaaagcattgcctgcacatgcagtcacaaacacaaataatatatcttcaaagtcaggctgggcttcgatattccattaacggacggattgccaacacattgaagcacgtaggtgactatttggtatttgcatttctttctctcaactttctatttcattcaaacgtacatactctcgcacatatatgtattcattaatataatttggttttacttcggagaccctgtattgctttgcctggcgaaaatataccattgcactactaggtcgaattaaagatgaattcaagacccaaaattggaagggatagctaagactgatgaatcttttaaccatattaaaaccagttatctcaaatatcctgttacacgtgattaatagataatatttaatctctacgtaaatttagcaacaagtattcctctgtattgtaatttattacatttcattttgcatcgaaaaagacctgttatgttttgtgaaggttatgtatctaactgtacaaatcatcgtcatcttcaccagcggcatctccgaaagctgcaccagaaccctcagcaccagcttgagttgcggcagcacctgaatcatcaccaaacgagaagttgccgaattgtcctctggatgccttcatctgttgagcataagcttcgtaacgacgaagctcagtatctgtaacagaacgcttggctgttttcatagcttcagtgaagtgttctttggtaatgaatggaactggatcctcttgttgaacgtctgacatttcaacgtcttcttctgtcttgaccttctcggtttcttctgcaccttcttctttcttgacaacttctgcacgtttttgtgcctcgatggaatctttaatggcaaacttcgcagctctctgtacgatatataataaatctgcaccagagaatccctgtgtagcttgagcgatggtctttagatctagtcctggttctaatggtgtatttcttaattgggctgatagaatagataatcttcctgtttcgtctggtaatggaacgtagatcaattgatccaatctaccaggtcttaaaatagctggatcgatttgatctggtctgttagtggcaccaataacgaaaacgttcttcttggcgttcataccatccatttcggtcaataattggttaaccactctgtcagatgcaccacctgcatcacctaaagaaccaccacgagccttagcaatggagtccaattcatctaagaaaacgacagttggggctgcagctctggctttgtcgaaaatatcacggatattggattcggactcaccgtaccacatacttaataactcaggacccttgaccgaaatgaaattagcagacacttcggtggcgacagccttagctaacaaagtcttaccagtaccaggaggaccgtagaacaacacacccttcgatggtgacaaaccaaacttggtgtattgatctggatgcaagactggatattcgacggtttccttcaattcatccttaatttcatccaagccaccgatatcatcccatgtgacattaacagattctacaacggtttcacgcaatgcggatgggttggagttacccaatgcaaatctgaagttgtccatagtaactcctaatgagtccaacacttcggcgtcaatttcgtcttcatctaagtcaattaggtccatcttttcacgaatttgttgcatagcagcttcagaacatagggaggcaatatcagcaccaacataaccatgggtttcagcggccaacttttctaagtcgacgtcgtcagccaacttcatatttttagtgtgaatacgtaagacttccaatctaccagtaacgtcaggaacaccaatatcgacttctctatcaaatctaccgaatcttctcaaagcaggatcgatagaattgggtctattggtggctgcaatgacaacgatgttggatctagccttcataccatccattagagtcaataattgagaaacgactcttctttccacttcaccgttagtcttgtcacgctttggtgcaatagaatcaatttcatcgataaaaataatggccggagcattcttttctgcttcttcgaaagcctttctcaagttggattcagattcaccagccatcttggacatgacttctggaccattgattaagaagaaaaatgcacctgtctcgttagccacagctctggccattagagttttaccggtacctggaggaccgtacatcaaaatacccttcggaggtttgataccaatggccttaaatagttgtgggtgtctcaatggcaattcgaccaattctctaatttgagccatttgcttacgacaaccaccaatatcatcataaccgacttcattgatgttattttcttcatcttctctgttaattggctcaccttcactatgaatgacagtatcttgggcaacaacaccgtactcttcaggctcaacgtctacgaccttgaactctacttgtctcataccacctctaacgataaagtggtcaccttttctaaccggtctataagcttcgacaaagtatggcttcaagtacacatcaaatagattaccagtcaacccctcgatggtgtcagcgattggcaacactgagattctggaagcatacttgatatcggtacatggatggatagtgaccaaatcaccgagtcttattctcaagttgttacgaataacacggtttactctacagacaccatcttccagttcgtcatcaatcataacaatcaaaacggtgtcctttctcttcttacccttgactaaaacggtgtcaccacggaacaattgtaaaagatccatagtgttagaattgatagcaatgatagaattgtcatcgttaactgcatcatcgaccagtaacatgttttgcttcttctttcttctcaagatggcagtggcggtagcatcatctgcgtcagctgcagtgccagaactatctaacaatttcttatgttcttctggcatgttctcttaataactgaggtgaaaagttgttttaaagatactgtaattccttctggtaggatccacgatgtaattaagctcttggtaaacaggatatgcaggtttcttgattaacttctgaaattggaccttatttcttcttatttcaaccaaaagacggaagataaaacaaaaattaaataacttgatctaacccctaatctggtgattcaatgattcaattaaaggagacaattattgtaaatccctggtgagtgctttatttaatctagcgttcacttactggtgttaatcctgaaaataaccttcaaggatcaccgaaaatagtgtgcaatacttatatataataaatcgcttccctctttataatctagagatttcagaatttgccaccggatatgtgaaatttcggccgggtaacaatattttttcatctcctctctaagaagatccctcccacaatgcgaatgagctattggattccttatgtgaatggtaagtagaaattggtacagtaggaaatatgtagttataatatatatgagacgatctcaatgatcatcttcgttagcttcgtcagcttcgtcagcttcgtcatcttcgtcatatcttggtctctttcattgcgaaaaagatcgcgcttaggtttctagtttggcaagcaactttttatgcatttcactcagcttagcaaaatcagtttcctgtgcaggccaacctacgattaatccagcatcctttgttttctttgggatcaaatggaaatgcacgtgatctacttcttgatgggctattctaccgttgttttgaaggacattgtaccctggaccatcaggaccatcttggtcgaagccaatggctttcactaacttcttagtaactggcaacaggtcagctaagtattcatctgggatgttgtgcaatttcccaccgtggtgctttggaatgataagaatgtggttctcttcagttggttggatgtcaaggaacgagtaagaatactgagtttcaaccaatttgaaagaagggatttcacctgaaagtacaccagtagtggaatctgttagtattatagttcataagatcaaagagctagtctaagccacttgggtggttgcgagcatgcaaaaaccaaggggagaaacagatatttgttctcacctaacaatttgaggtttacatacctttgataatcttgcagaaaatacaagcagcgtcgtgggcaacagcactcattggtatcggcttattaaacgtttgaattcacacgtatcggtacttattgcaatatttctttcgactgcgaaaatgttggagaatctgcaactaattggagttcagtcttttttcatcattatacatttgtgtattggcccttatatatatgttcttatgatataaaaaaaaaccaagttctagaaaactagaatagttggtgacacgacatgagaatcatgattcggagtggttctcgtactaatgtagggcacgacattccaactaatgattgtttctggtttaatggtagacaatactagaacctatctttagggtatctgccttaattcttttctagatttgctgtatatttgttaattattcttgtccaatttattataattgttccagaggtgccctttcaaagtggaaatgttgtaattcctttacaaaagttatatatagggattgtgttgggagccgttactattgaacgaatgaaacctgagattataaagcgctaccagagctcagcttaaaacacaaagctttctgacataatcgcttcgatgacgggcatactgacggaataagaaccacgtgatattaattgtttcacagatatgctcgaatgaaaaaaaaaaaaaaaagagaaaagcagagtcatcgaatagctccacgaattaacttgaacattttattgtttgagatcatcttgatatatattgagatcctttgtgtacttcatagcttgctgattttatcgcttaagacctgcaggggatatcttcttcggcagattattgatctgatcttaatatcttagttttccttcttcgatatttagaatcgcattcttcctcgataccgaacatatattacgacagatatcatgattagagcttcaattcgtgccagttcgagggtttctagccgtttacttgcttgtaagaactgttatgtccctgtctcacaaagaatcactagtgcgttggtatcaggatccgctgttaataacaacattagattctactcggataaacctcaaccaaagttgactgttgagaattatccaaacattaaacgtttggaatcattcaagaagttgggtaaggaagatctagactatttcaaaaccattctctctcaacaagagatcttggaagcgaatgaaaacgaagacttggctttttataatgaagattggatgaggaaatacagaggccaatccaaactagttctaagaccaaagactactgaacaagtttcaaagatcttgaaatactgtaatgaacaaaacttagctgttgtaccacaaggtggtaacactggtcttgttggtggctctgtaccagtcttcgacgaaattgtgttgagtttgactcagttgaacaagattagagaattcgacgaagtctctggtattttgaaatgtgatgctggtgtcatcttggaagccgctgatatgttcttggcagaacgtggctacattttcccaatggacctgggcgccaaaggctcctgtcatgttggtggtatagtagccactaacgctggtgggctaagattattacgttatggctcattgcatggaacagtattgggcctagaggtagtgctaccaaacggggagatcgttaacagtatgaacgctttgagaaaagataatactggctatgatctaaaacaattatttatcggatctgaaggtaccatcggtgttgttactggtgtttccatcttgtgtccaattaggccaaatgcatttaatgtctcattcttaggtgttgaaagttacgaagctgttcaaaaagttttcgttcaagccaagaaggagctgggtgagattttgtcagcctttgaattcatggatttgaaatctcaaaacttgacaaaaatacatttagcagacatggaccatccattggctgatgaccatccattctacattttaattgaaacttctggttctaagaaggaacacgacgatgcaaaattggaagccttcttggaaagcgccatggaagacggtttggtcgttgatggtgttgttgctcaagatgaaactgaattgaagaacttgtggcagtggagagaaatgatcccagaatcctcccaagccggtggaggtgtatacaaatacgatgtttccttgccattgaaggacctatattccttggtggacgctgcaaatgccagattagaggaacatggattgttaagcatagacgacgagtccaagccagtgatatccgccgttggatacggtcacgtgggtgatggtaatctacatttgaacgttgccgtaaggagatataccaaagaggttgaaaaatgtctagaaccatttgtttacgaattcgtctcttcaaagaatggttccatcagtgctgagcatggtctcggtttccagaagaaaaactacatcggatattctaagtccgaacaagaaatcaagatgatcaaacaactgaagaatttgtatgattcaaataccattctaaacccatacaagtatgtttagagagacaattcaatccagtggctgtgcaatgacagacaatgtacaacacatagggtaggagaacaagctttctatgtatagatcccaaaacgtactttaaacagttcattacgtatataatatattcacattttcaataaacactgatatatagtagcaaacgattatgcaaatcaattgactcataaaaaaactgaagactttgactgacttgcaattcctttcaatcttggcgtcattacgaaagtaatcgttaaacacagtaatttcgtcagtactgtatatttgtggcttaatcagtggcacttttcttgattagtaattaaggttcaagagtcatagagatgtaaagacaacagcaaggccaatactgaacaaaaagacataaaaaagacattattaagggaaaagttagcacgcgattgttaactcgacaccggcaactgcggttgcatcaatttgagccgaacatataaaaggggagcgtttttataccctaatacaactgttgggagcggaaatcaattgttgtctatacaatttcaattgttacttcattcaacactaataagcattccacaccgtcggaaaccacattcatcaggttcaccaggcttataattaatatcatgactactcaaaagttctttactttgtctaatggaaataagattcctgcagttgctattgtaggtacaggtactgcttggtacaaaagcgaggagacagatgccactttctcccaaccattggttgatattgtgaagaaaacattggatactgtcccaggtgttgtgcacattgatgctgcagagatatacagaacttatcctgaattgggtgccgctttgaaggatacaaagaagccaagagatgaaatcttcatcactgacaagtattctactttgaaacagctttctgagaaccctaaagttgccttagagacatcattgaagaagctcggtgttgattacgtggacttgtatctattgcactctcctataattaaggaaagcaaattggatgtcgaggctaattggaagtatttggaagaactatacaagtctggaaaggctaagaacatcggtgtttcaaactttgctgtaaaagatttggagaaattgcttgcagtggcagaggttaaaccgcaggtgaaccaaattgaattctctccattcttgcaaaatcaaactcccggtattgttgaattcagtcaaaagaatggtattttacttgaggcctactcaccattaggtcctttgcaaagaagaccagaagatgctgataagctacctttttaccaatatatcgctgaattgtcaaagaagtataacaagagtgaggctcaaatcttgttatcatgggtctatgagcgtggaatcttgccagtaactacgtcttcgaagatcgaaaggatccaacaagcgcaagatatctttagtttttctttggctaatgaggaagtccaaaagatcactcaattgggtttgcaacatccagctttgagattatactggactgacgtatactcaaaatacgattctgaatcccagaagtgattattccatctcagtatgttatgtcaatgaacactggctctgagagcacacatctttttaataggcttgttaaacatctgttgactatatttacaagtattgctttacgtgatactattcctttaggataatgtcgtatatacatattttcgtttgcagaatgaggttcatataggaaacttttaaaatatagttaaggcaagaacttccctttcttcaagctttccacagctgtggttgaaatatgtcggaatctagcgggccccaatgctgtcccaccgtaccatcttgtaacaacaactaaaacattagcaatatgacttctttctaacaaggttaaaagtctttgtcctgcaccagcctcaccacagtcatttgatccttgttgtatattctttaacattgccggccctgtcagttcaccaggcactgtcaatgaaccccttttcctcttcttatttcctttcttattgtgctcggggggtataatatctgccgttctccatgcatacatatgcttgtgcgttgccttttggacggccttatttttttccactaatacctccagtaacttatcaacttcagacaggttcttgatagcatggcaccttgcttgaaacttggattttctatctaccaaaacttcggattcgttccaccctatacctgtcatgtatcttctggtaattcttagataactataagatcgtagcataagatgtcgacctttaccataagtatcaaatcgccgatgtatattaatttctgtccacctgcttgaatagatgtgtgacctcctcgattgagcacgctccgcatgtgttcatgacagtattggggtctagataaccttcataattttacgttgttgtgttctctgctgcttatgaatttctatatcgtctgtccttttatatcgaagatttagcgatgaggttttagtctttcaatttcacaaaactcaatagatgaacgttattcagtcgaactaagacgtttaagtgaaaacacccagaaggtggaacgctatccttataatatccagccaagattacctgaatgcaatcgaatttcacctttttggtttcacaaccatcatgttcgaagacaactccttcaggttaccgagctttccaatgtaaagatgacaggatccatcctttgaaggtaaacaccaaaaatcgggctgctgataccaatagcataatacaaaagttctgttatctacgaccaaggagtatgcctattgtaccgacatcaaaatatctgcacaatcaagagcattcagactttcttttggttgcaaggaataatggcataatcgaaataataaaggactacaattttaaggtaaccaataacgttcctttacgaccagattttctactattttgcgtaccaatgacttcgagtataactacaaatgatacaaccattgttggtttagagtataaagataagtttctatatgtatgttctgcggttggtgacatatttgggttcatattgaacttaccagacgattacgttcaagacgaagaatttcaagcatcaccttcctataaacggtatagagattctttctcttggagatcggacatagtacaatcttctgacgcaacagctgcagaacggagcttaaaagaaatcactcgattcagaaaagaacatagttgtggccacatttgttattattgttatcctatcaatgaagacggattcttccatgaaacgataaaacaatggtatcccgaccctgtaccgacattttcaaattgttttgttacgtttttgaggacagatgttagctcatttcatatcaacccgatggacagattcagtgtcatcaccgtggcaccgcagacgccgttaacaattcacaaaatactcttacctgaggtgtatacgacattcttctcagaatttgtaaagcttaaagatgagtacttctccaaaaagcacagaagggtttcagaaccttccagttttgattttatgtcaagagcggttcatgggacagcttttcaagaatatttgaagagagatcgttcaagctttgtcatggaacaagatgttagggtatggaggggaatgctggtttgcgatatggtttgtgaattcaaatgctcctccgtttggaggcaaaaacaaggtaatatgaaagatggcttacatgaattgttcttttatgacaaaaaacaagaagcaaataatcgcaatgaaagcgattctgttgctagaaatgaaactgtagtcgacttggagctggattcccaatcattctcattacttggagtttctaccgagatattagataatcatacccaacaccaatctaatataacacaaactgaacggtttctaaaattcttgcggaaacagacgttccctataaatttccaagtggtaaagacagtaagcctcgacggtgaaacaaattcgacagggtatgaagctgcaacttcttttcttacagatacttacagagatatggatgttgttgttgtggacaaatttttaagtgtaaacgcttttcgtcctaaatacgtggacgagcctctgatgaagttagattcaatacatgactatctggaagtaaatgaagaagacagagatgctcatgtagctttaaataatctctcctcattcatcaagtttttcatgcttactgattccctttgcatgatttgggatatcaatggaatattgttggtggatagatttcagctaagaagtacaaggaatctactacataacgatgtcggggctgttaaagtaataaacttccgtgtaggaatagtgaatgatattgggttagttttaaatcagttcaaacaagatggttctgactattatattgagttttattccatcttaacaacgttaacgggagatatcgcactactgaggggtgaattcaaagttggccaacgattaggtactatgaagatattagatagtttgagaacgcaacaatcggataactttgttgaccaaatattgattacaaactactcactatccaataaaagagacgctggaatggtaattcctgaggtttttaaaatgaataaaagatccaaaacttagaagtctttcaacaatgtaagtcaaaataatctatacgtttacgtgaatagcagctaatataaaccctaattaatataatggtaatccttgtagaagatgtacaacaatcatgaaatagcagaagtaaaaaaaaaatgaggtgctgataattaaccgcccctaatcatacactttctgtgtatggtgggggagaaccctttggcacatcctgagcgtagttatttggttcatatcttagaggaatctgagttcttggcaatagaggatcttctacaccagtgggttgatgagaaacggtcgttaccgcagatgggcttccatatctttgtccgtcattccacccttgctcataataataacgtgtttcggtatccgtccttagcggtgacgtgacggtaatataataaaaagcatgaatcattccagggaggaacccaaacatagttagcaacacgtttaatagtaagtcactggaacataaacccgatctcaatcccacggcaatcggtgggaatattatggcaacaatataaagtatcaaatctgatacagtacagcagatacagcacagacacatgtttcaaaagcttttgataatacactgctgggagtataagggaaacctacgaggctcttcttctgtatcccaatgttgtgaattgagatgattaataggtatgattcattgttcaaattttgacaattatcaactaaagaaaactatgggaaacgccatacatatgacaaaaatgattgaagccacatagaccatttgtgaatgcttataccgaaacaagtacaggcttttgaaagccagtagcgaatgtatatcttgacacccctttgacaagctatatctcgttatctaaatcaacatggaaggaaaatgaagtcacatggtaaattaagtatacacgtacatcttagaatttttgtttttctgtagtgatatgctttggatgatagttgattgattaatcgcctgatgagggatcgttgatatcaaacaatataacgaatataatataataatctatttagttagatcgttgagtttatgcgtccttgctcttctttctcttgttgcatccaacctccccaagaggtcgcaacatagctcagccttttatactcgacttatatactcggatggtcgtcagacttcgtcatggcaactcgttgcctccatgcccttgtaggtcctgtgcagctaccgtcctccacgcgcactcaagaccatcacgtgacagtctatgatccatctatgccatccctctggataccacaggatccatatgcccagtcactgacgtcttggaactctgccgtgtgctggctagcccacatgacctctcgtctggcttgtcctcagtctatattacgacatttccaacaaatttggttccttggcccagttggttaaggcaccgtgctaataacgcggggatcagcggttcgatcccgctaggaaccattatttttatcgctctctatttttggctcagtttattatttgacaagtactagtgtctgtggaaagcctaatatataagcctcgcggaaacagcagccgagaaaacgcagttggcttgcaactattttttcatctttccataaattacgctagttagtacaatattgttcaaaatctctgctattcttctgagacgagacttggttacacatatatatgtatttggggtatctatattgaatcaccttctctttttgaaaccggagtaggagttatactttctatatctatcgtttgagggttgatatgagctgctcccataacgaggaatattgacgttaggatttcttgggaaatctaacggatgtgatctcgttggttttggtggtaaaactttacccttgactgtaggagcaggtgcgtttgatgagccattactgtgattatagttggaccttttggactttttgttatatggaggagcataaaagttagatggctttgcatcaccgtagtccatagctggttgtttcttatttttgttattattataatagtagttatcctcaccgtcatagttgaaatcgtaggtgtcatagtcatagtcgtcatatgtgtactcgtttgccgtcctctctttgtattctttcaaattcctgccataatcctgccttacagatgacggaaggttgtttccagcaaacgcagaaccgtcatcgttaggtaccctagaagacctagccgacatacaatcatccccgaaatgtccttttccaccgcagttatagcagaatatcagatgcaagggcataagtcttttctgtttggagtccttgagacaataactcctccaaatactcggacatctatctcttgaatgcttgctgctattacaaagcgtgcaaaacacacgcttccacttcacaggacagtgttgtctgtaatgaccgggctcattacagtgcgagcatctcatcgtctttggacaatgtgtcgaataatgatcatccatcacaccgcaatatgaacatatcacatgaggacaatttttcttcaaatgacccctctgcgaacagttgttacatttgggtagtggctctactattccatcctcaccatcctcaataccaaaataccgtccttgcccacgtatctctcttaacttctccggatcagaatcaacctcagttatgcttggtgctattattttatctctgtcggtgatttcataactcgggctggaatccttgaaaaaaggaagtgtatctgcagtttcaacttccgaaagcattagtgttttcaatagttattggctcactctagatatctgaactatctaaatactgcaatctctgtatatcttttattgtgcgagatgagacgagatgagattgtacgttttctatttgaaatatgatttttttcatttcacttttgtcaagtacgaagtatttttttttcttatggggccatagtaaagaatttgacgagcgtcaggaagccatagatgatatgttagactatattgatgcctggaaatttgaggataggtggttgcgattagcacttttaggagggatgatgattatagtcccggttcttgccattaatactgaataaaaaaaaacatgtgagcacaatatataagacagcattctggtcatcaaaactccaagaacagaaatccactaaaatgatataatactgtaacctcagtaaggtccgaaaccaaatgggagaatgtttccaatattttccactggtacattagtatcaatttgatacattatgaagagtactcacgtgaccatcgtccactatgattttcgatctcatcgttgatctctgaaaagaaagaaaaaaaatttcgaaaaagagatttgaacacacaaatcgttaaaaccaaaagttcagtcatacgaatttgcacacacatacggaaggaagatttcaaccaattcttccgtgtactattattacagcaggcctccctttctgatagccataagatataagaagaactcaaaaagcaaaacagtatgagtgctgacaacggggtgaaagtcgttgcggagcaggtacaagatttgtccttggcaggtgagaacaaggctgttgaagctcaagctgagaaaccactagtgaataagaaagaaaagaagaaggagaagcacaatggtaagaacccattatatttggaccctcagccagcgttcattgatgaacgtatacaaatgttcgaccgtttaaagaaggaatacgatgacaaagttgcagcagcaccacgcgttgcattaaccgtagtcttgaaggatggatccactaaggaagccaccgcatgggaaacttcaccaatggacattgctcaacagatttcaaagtctttctctgaaagacaatgtatttccaaggttaacggcgagttatgggatttggagagacctttagaaggtaatgaaggtgatgaacttaaggttgaattctttgattttgaatctgacactggtaagaaagtgttttggcattcttctgcccacgtcttgggtgaagcatgtgaatgtaacttaggtgctcacatctgtttaggacctccaactgatgacgggttcttctacgagtttgcatgcagagattcaatggatgccgattctccagaaagaactgtgtcacaagctgatttcccaaacttggaaagtgtttccaagaacgtcatcaagcaaaagcaaagatttgaaagactcgtcatgtctaaggaaaatttattgaagatgttccattattccaagtataagacttacttggttagtaccaagattccggatggaggcgccaccaccgtctacagatgcgggtccttgatcgatttgtgtactggtccacatatccctcatactggtcgtatcaaggccttcaagctattgaagaactcttcttgttacttcttgggagacaacaacaatgactcattacaaagaatctacggtatctctttcccagataagaaattgatggatgctcatttgaaattcttagctgaagcttccatgagagatcatagaaagatcggtagagaacaagaattgttctacttcaatgagatgtctccgggttcttgtttctggctgccacacggtaccagaatttacaacactttagttgatttgttgagaagcgaataccgtaagagaggttacgatgaagttatcactccaaacatgtacaactccaagttgtgggaaacttctggtcactgggctaactacaaagaaaatatgttctccttcgaagttgaaaaggaaacatttggtttgaaaccaatgaactgtcccggtcattgtttaatgtttaaggctcgtgaacgttcttatagagaattgccatggagagttgctgatttcggtgtcattcacagaaacgaattctccggtgctttgtctggtttgactcgtgtaagaagattccaacaagacgatgctcacattttctgtacccaagaccaaatcgaaaatgaaatcgctaacattttcgatttcttaaaatacgtttatggtgtgttcggtttcgaattcaagatggaactatccactagaccagaaaaatacgttggtgaactagagacctggaacaatgcggaatccaaacttgaaactgctttgaagaagtggggtggtaactgggaattaaatccaggtgatggtgctttctacggtccaaagatcgatatcatgatttccgatgccctaaagagatggcatcaatgtgctaccattcaattggatttccaactaccaaatagatttgaattggaattcaaaaccaaggaattggaaggtagcgacaattacgaaagaccggtcatgattcatcgtgctatcttaggttctgtggaaagaatgactgctatcttgacggagcactttgctggtaagtggccattctggttatctccacgtcaaatccttgtcgtaccagtcggtgttaaattccaagaatatgctcaagaagttcgtgacaagatggttgaagctggcttctacgcagacgttgatctcaccggtaataccctacaaaagaaggtcaggaacggtcaaatgttgaaatataacttcattttcattgttggtgaacaggagatgactgaaaaatccgttaatatcagaaacagggatgttatggacttacaaggtaagaacgccaccgttcaagtagacgctgtcattaaccaattgtccaagttgaaggaagaaaagagagctgataatgtcttggcttaaaggaatatccaaaccgatcatatatttgtcaacagaaattctaatttattaacctttcaacagttatagtttgtcaacactatctcgtcgttttaactcccttaccatgcaagtcgtatatttaagctaactatcttttctgtctcttaactcatgtatattgttagatataaactaatataaatttcactaattatcatcggaaataatatgaatgatggacctttttaattcgttgtcatagatggaatatagctctaccggagcaatcaagccttctgttaagtgtgatttgttctgttgtcatgtatgatgtttgaaaatttatctctttttacaagtactctcctttgttctgcgtgatgcaggataatcctgataagatttctgcgaacttcattatttataattggtatcgctgttatcataatcatgttttctaatttcttcccatgatttaccattctttgtgtctacagcggtgttctcctttctaattttgtcccacgatgacagagtgggttcctgtgtctctgtgtcattgaatggatcataatcatccctcggagtcacctgagaaggtggggtagtttgagagacaccagtctttggcacaccttccttcttatcgtattgaggtcctgtatatagccccattgggtccttgttgtcgaataaaactgaggagtttctcacgccagaattgccttccttcaatttgtccattacaagtctgggatcaggaattcttctttctggattcttatatgtcatgtaataatagttcgcccatctggtaggcattcccatgtttaatagctttagaatttcgtactgcttctgtcgactactttttggcaaatgcggatcatcttccagtatgtctggtttagcagccttaagtttagatttgtacgccaaggagccaccagcttgtgtgccaataaacatagataagaatcctagagcaaaagctctagtaacttttgtcccttttatagctccagttttcatgtattgattaacgaaaggaataccagtaactattgcaaatgcaccccacccagaccataattgggcccttgctactgaaagataggtcttagatagttccaatcgatccttaggatccaatactttgtccttctcgtaaaattccaacgcattgtcatacgcttttttaaaccatggtgaattcacaacagctgggttttgcatcgctttatctacaccaaatcccattgggaatgatctctgtgagttttgttgcgtttctgcgttatctccctgcattacttcctatgaagatcgaaacttccaaaaatgtctgttaaaaaaaaagcagaactcgctcgttattctaatagttcgtacacttgcaaaactacagcttccaatgcgcttctgatgttgttatttaacattctcagtttaccataacttcactttatcttaacattcaaattatcgatcatcccttatgtatatttacgcaaacaacggtaatttaacaaatatgccacataatgcgaaatattccaaaacttagccgattatactgatcaatacaacagtaaaagagcattaggcgctatactgaatgtgatagtaaggacttgtaatcttatatctactagcttgatacgttccctattgcacgtgaccacattctttactacaaccaagtttcttttccgaacgtttgattcaaaattttaaagctcatctcggtcatcgccaaacatttacgaactaacaatggctacttgagcaagctgtttgcattgatatgctctgttaatcaactgacgggaataaagtataataggataacaattacaagaagtttgagatcgaaatgtcacgtccagaagatttggcaccaccagaagtgttttacaatgacagtgaatctaagaagtatagtggctccacaagagtgcaacatattcaagctaaaatgacacttcgggccttagaacttctcaacctgccacatacatcatatatcttggatattgggtgtgggtctggtttaagtggtgaaatcatcactgaagaaggacatatatggtgtggattagacatttctcctagtatgttagctgaagcgctagaaagagaagttgaaggtgatcttatgttacacgatataggtcaaggtattccatttagagcaggtgtatttgatgcggcaattagtatatctgtgattcaatggttatgtaatgcggacacatcgtacaacgatccaaagagaaggctcatgaggttcttcaatacactatttgctagtttgaagaaaggaggaaaatttgtagcacaattctatccaaagaatgatgatcaaatagaccaaatcttgggagcagcaaaagtagctggattctctggtggccttgtcattgatgatcccgagtccaaaaagaacaagaagtactacttggtattaagctccggatctacagaacagaatgaacaagtcaacttggatggtgttaagatggatgcagatctaatggtaaagagagagcgtaaaaagaaactagttgaatcaagtaaggattacatcaacagaaagaaggaggtgatgaaaaaaagaggtagaaaggtagctctcgactcgaagtttacgggtagaaagagaagacctaggttttagtatggtcttgcatatatagaattagtagatacgcacttaatacaatcagcaaacatggactgaaacgttatcattcattcaccattttccgtgtctattgcatctgccatgatcaaaacgtttaaaatgatcatcaaacctatgttgtagttttccatagaaagaacattcgaaaattttggttaaaaaagatggaaacataagtacctaagagttaagaaagcactgaagcgcagtttatatttgagtttaagcctttactacccgtcagatcaagttcccattccaaaactatattagtcccatacaatgttaaagagactactacctaccgttatcagacaatctgttagaagttatcaacttccagctaagagtggaagaaagattattccagtttacccaccagttgaaagaatatcctccccattagtagtgaagactctagctgatcatgatctaaaacaacttgacccaactggtgtaaaaacagagatggtttcaaagaaaaacccaaatcgtctacgtgcaggtgatgttcttcgtgtagtttacgattccaagaaatgcaactacgatagttttactggatatgtgctatcggtagaccgtaagccaatagtacaagacacatccattctattaagagattatatttataaaacctgtgtggaaatgagagtgccaatcttctcaccattggtagagagaattgatttgattagaagagcggatggtaagagacgcagaagtaaacattattacatcagaaacaccagattggatgtcggagatttggaagcaagtatgagaaagaagaaatgagcacattcacactatcaaacacttgctgaattttcataaaatgaaacatgtacatagaagcaattcaaacatatagtaagtaatgctcgatatcaatgcaaacccaaagacaaggaagattcaaagttgaaagagctccagagttgaaccataatgcaaggtactctatgcaggtccagcttctctaggtaaagttatttgtatcattagcatgtcgggtggatatataattgtataatctgtaaaataaaaaggcggattatgctagtccttatacctcatcaagtgcatccaataagaaaggaaaatcatgagaaaggataagcataagaaaggatttgtacgctctatctaaaacaaagctgcattgagtgagcaagttgctctattagaaatgaaaagattacaagcaattttggtccgcatttttgataatttatgaaggttcttgattggttcaaaaaagtagtggtataatgttatgaaagccgtaccagccgtctctattgaaaaaaaattgaaataagctgacattaaaaaacaaccataacaggtaaggcagcacgcccgcatttttgatctcgtggatggttgcgccacgatgcaatgaaactgttacaataatcaatgataaaaaatagatcttcttttattaacttgtcatgacatagaataatgtgagacaaaataactcaccatgaaaggtagatttggtacgttagatctgcttcatttcatttcgtacaaggcagtgctgtaaaaaaaaaacagttaatagtatatgggtcaaaattattcacaagaaggatgtgatgagggtgaaaatagaattgtacgccttgtagtgtgaaggcaatatcgtatttcacctcagctagattgaattcttcaaaaattcaatcatatttaaaaatcttggccttaactctgtcttcgttacttctgtaaccagcggttgcagccatctcttcttccttctcagcatgctccaaagccgcttgccaacgacggtctctagcctccttcttttgatctggatgtagcttttcctcgtacatagataaaccaattgaggctagtaacaaaatcacagttataccttgagcatacattcttgcctgcacagccttttgggctttggtcatgtataagtccctatcaaccaatttccaggatccatacaaggaagcagcccatgcaccaacaatgatcttgtacttattgttggacaaaccttcgaccaatttttcgctcataggcaggttcttccatctgttatgttcagcaagaatatcactggacgaagagtcaccatacattttcttatcaaaactgttagaagattcttcagcgacaatagaagccaaaagagttggaggcgtgatgaataaagcagtcttgacagaccatgtcatagcctttggattgaatttaggataacgatggggtaaaaacctgaacatagctgcagaaattaacagacctgcagctgcacctttaacaccacccatcagggtgtagtgacgatgagcatcaatttcttctcttgttaaaatcttcatcttgctgtgctggttttttcgtctttcagttacttatctcttaagctaacttttgattcccttagtttaaataaggtgataaatatcgaattaatactggaacaaaatcctaatatatcccgatatttattttagccaagaggataagcattaacaaattttaactgtcaaacgatatatatatatataatttgaaatgattctgtaaacgaataaaccgagagaatgctcttccttatatacgatacttttaaattccctccctgcctttgttccaattatactttaattttggttcgattttacttttttacttttttccttcccgtatgataaatattctttgttcctttatttctttttcctgcaatatcgtatacgatttaggatttatgattgtccatgaggcactgctactgatgttacgtaattttggcagttagccaaaccctatatctctcgttcttgttgccagcccatgaacaggctcagcgtaacctgttcattgctatcaacgtatcaatgaaccattcgattgaaatttcttccaaaggtcagacaagtttttgtctgaaaataactccgtcaattagaaagtgactatgttcattacactgatgttcaaaatcaatccatactttagcgaagctaatacctaagtgggaccagccgaacgaactgtcctactcagaaggatttgcgcgtgcatacggagatagtggttttagtagttgttacctgagaagaagccggtcggaatttgccacggttgtggctccacatttccttgacacaaagtttcctgtgatatgattggtcagtcacacatgtttaaaaaaaaaggaagagcagagaatatgcatcgactaaccctaacagctggaacctaccagattcatccaatagagttacaggatcttcgaaaagcttcagttttggacctaaggcatcggatcgttcggataatatccattgcaattagtgcagtgttgcgttcattagcctgaccttttaatacaagggagagtgattaccattttgagaaatcgccgaaatactatttttcaggtttctactcttaagaaaaagagcttaatatgtggaaagcctttgctttgaatatggccagcagagttttgtacatcactctgttttgacgtaaccgatatgtatactagcttgagtctctactgaaatacttgtaaaatgaacgcatattagactattgaagatttttttcaactagttaataagcgaacactgatacgtcatttttttttatttttttcatggatcgttttgttcgactcttcgactcttcggatattatctgacgcgcgacacaaaataataatgtgaacacttaaaaagtatgcgactttaatcatgtccctggttcgacacactattcgttagacaatgacagggttccgagttcttaaatcgtacaatttaccacaataactgaaaatggatttagtagaaaaaatgtgtattaaggcaactaacctccatccctagtcttgtcaacaatatttgcagaaagagataagattgcaagatagttaactaccagcagagaaaatattcaacagtcagaatgcgaggtatcttgactctttttgttatttggcttcattttgtttatcctgtcatatgtactgaataccttgttagcttgaagactccaagagctttaaggtatgttttcaactttaaaatcggcgggtccagtgtcaaggaattgatagaatcgaagatccacagagaattctcattcggtaagttcaatgccatttctgttgatattcctcctgttctagcggataagttgaaagatgtaccatttataagtgatgttgtggctaatgtgaagattagtttgttcgatgagttcccacaaatcgcttcaggattaaacaatgatcaatatgacttcgaaactgaagatgaggaagaggcagaagaagatgaggggagtgatacttatgaagatgatgataattacgacgaggatacagacaatggagataccgattttagcgatgacttcatctcacaatctcgagctccaagacatctagcaagaatttctcgaagagcacagttaccagtcatcgagaaagatgatacctcatctggattgaaataccattaccatgaagaacaccagggtgaaggggttttcgtttatgtacttgatagtggagttaatcatgaccatcccgatttcgaaggaagggctatgaaaggtattgatactactggagaaggctccggagatctcgtaggacatggtacccatgttgcaggtttaatcggttccaagacttatggagtggccaagaaagttaatattgttgaagtgaaggtcctagattccatgggaaaaggcactgtcacaaatatcatcgaaggattggaatatgtcgtgaaccaatgcatcggaaagaagagaaaatgtgtcataaacatgagtctcggtgcaccaggaacccattcgattttagataaagctgtttcagcagtaatcgaagagggtgtcgtggttgttgttgctggaggaaacagtggattgaacgcatgttggtacagtcctgctaaggtcaggaaagcaattactgtggctgcaatggacgatagaaccgatctaatggcaccattctcaaactggggcgcttgtattgatatatgggctcctggtgtcaacgtgaaatccctttccaataaaggccggggcacttttgtattgagtggaacatcaatggcatctccaatagtagcaggtgcagctgccatctatttggatcaaggtgcagaccctgctgaagtgagaaagatattgagtaagactgctacgagaggtgttttcaagaagagagctattgctgtaagaccaagaactccaaataaggttctctatacaggaaacaatcaagaggatgatgaatttgcttacgcagtttacccgatgattgatgagataaaattcatggatcagttaaagcaagctacaagtcgagtgaaaccgccaagtggcgagatgattaatctagtaacacatgatagaaagatacttaaaccacgattgagtaagttcctaaaaaaagtgagtaacaattcttaatatattgacatacataatatacactttgttttcgttttagagcaagaaatcgtttcgtttcgtttcgtttcgtttcaggaagacacatgcccttttattcacatgatattaatttatgagcaaactagtgatgaagtgtcttccttcgttagaccatttcgttgtaagttcgtcacaaatgctgttataatttgttataattgctagagtaccagcaaggcccgcctggagaggcagataatagaaaagaaaaatattgacgaaagatgactttattaaaatatatacaagaccatgtatctctaaacaagctgctgctttatttctagctcactctttgatgcttgatttcagatatcgacagtctcaagaatggtgtagaaaatggtaatggagtaggaaaacatgcatggcgagaatggtgctgtggtggaacatagcatgaatttgctaaaattgtcatcatattgtacattatacgaaaggggaattcaacatgcaaacgtaagataaaattggatgaaatgggcggtcagtaaatacgagacattaggggcatatttcacatttgaaacaggatcctcatgcaaaccatttctaagacccaatgtaatagtagtgtagaatgaaaggaaacgaaaaaaaaagtttatcgtgtgtttatatatccacaggtttatccttttctttctttcaacttataagattacagacttgataccgcaccatcctgcagcagcagcagccatcaaagcggatgcgtaacccattggtttcaatcctctagaagatctgaaaatagcaccagttaaagcaccagctgccactgagccagcaacatcatgcttacctctgaaagaatcgatcactgagttgatcaagttgtaagttaaggccaacacaccagcattgttacccaaaaatggacctcttcttgtgatatggtttaatactgtattcaattgcaatttacctggtgagttaggtgggatgttcttcaacccttcaatgaacccataagaaccaccaagacctaaaccaaccaagtatacagcaccagtaccgtaacataaatcgtctgtccaacctctagatggaatcaaaccttgagaaccttccattgaagaaagctgttcttcttccaaatccatatactcaacaccacgctctagccctgctaatgggtgaagctgtgatggacttaatcctcctggaacagaaataacgttcgacacattcgaaattgatgatggatcgaatcctagagtttgtttcagtttatcatcattttgttcaactggtgtagtattttcttgtgagtctgtagatgacttcttaccaccgaagagccaagacatagctatactttattattattattattagccttagtttatatggtatcggtcaaaggatgaaaaatcaggaagagattagacccggtccgtattcgacaataatgaagccctgtatttatcggagtattgccttgatagactgaaatgcaatggtaacctagcaaaataccaatacggaaaagatgtctttgtcttagtatctacaactcaaaccttcgagggtgattcaacgtatcatactactactttaaacacttttcgattgtaaaattatatttcactaatttttcaaaatttcaaaatatttcaagaactacggttttttttttcttcctcttgtttcttcttgcttcacaagagactctgtgatttcaagaccattcaaggtaaaatcaacgaatcgtacaaaatgatgattcatgtaaccggaaccgttctgcagatgtagctgacctctgttttgagcgcagcgaagggtaaacagagagaaaaaaatttgtcatttcatttagcatttctagcgacaaaaaaaatatttaaaactgacgcccgccatgagacaatgttatttcacacgacattgcaaaagttatcactgggtttccaaacagatatcaactgaggtatctttggatgaaactttacctacgcagattgatagaaatctgtaaaaaggagcgcattgcccttaaattcgtacaaagaatacaaaggaaaattggggatttgttaggaaacgacttttctgaaattatacattttcaaaccagtatatatatataaagggatccgtataaacctttcatatcaatgtactgtcgctaatgtttttttttaaaatcgcctgggataatttgtgaaagcatttcagatactaaggtagcatacatgcactaacgcatttcaaggcttcacacttttgaataaacataaatttaatataaagagtgcagttttacatgaaaaggacgctggaacatatgtcagtctgcccctcagaaaaactccgatgaataatttagagaatcatcaattttcattctctgatgatttgttacactgtgattacacgataaaacacaagctgttaacccgctttatgacgaaaagtttcacccagtgattgaaatacaaacaaaaaatggcagaacgtagtgctagagtccaatttgatttgttcgagtccgaaaaagtgttgttgcgacacaaatggatcagaatattagaggagattgactccgaagtctcagtgacgcttggatttgatctatacaatactaagaaagaggatacgaagttgcaccactgcgagttgaagaaggtgaaccaaatgagagtcggttacgacgagttcctattgaagaaaattaaggaagctggaatacaaaatgcgaaatgatttctatcaatctaaattttcattccaacagctgctcaccccttgtatgcttaacgcttttttctataccgttgtaacaatttgtctataacttaactatctttctctcatgtcagtcagtttatactatttccgcttttttttttctgacgtcttgtagtcgcaaaccacaagaaaccgcaagtcacgtgatctcaaaccctcatctatcgctaatctattctaaaatccaatcgttgcagctttcacataaataaccgctgtatatcaaccgaatacaactactccatttccttcattcaaagatttgttcccttaaaacgccaaacgttctttcagtctaaaaccaagcgcattgcggttaattgctattatctgcccagatataacacacttcttatcctaaattctgttgcataccgttgctgtcaacgtgacgtgtaccaaattgttggtacatgaatcatcttgaacgaccacggatagtatgaacttatgggatctttatgaaatgttctacagaaaaacaaaaatccaacaacgatcccaacaagttttcaaactttttctttcccaaaaaaaaaatagtgctatgaaatttcaagtatggtgaaatcaccacatcgtttggatgaaatgcctagactgggatgtagaatggatagaaccaagttttttttttttttctcttctcatctttttgtttgttttgttagtttagttgaaattttgtctagatgaagtgaaatgcactcggcggctttttataaagaagaggttttcctgctatttttttcaagcaaaggggtttaaataaacttcgtgaatttaaattatatcaattctctaaatcttcttaggtttttatacattgtattttctgtctttctgaaacctcttgactcactttcaattgatcagtactctgtggaaactcatcaagagaaagggctaactagaagagataagatattttaaagatatccaaggaataattttagtttgaaactgaattactcaatatacacaacaaacaacaacaacaacttgtattgagaatatttatttgttcatcctatcatattcattctgatttcctgttaatattgacaataggagtttcacacaattaaatctgtccctttttgagtacaactattactaaaaggtcatcagccctctgacaattaatatctggatattgcgtcaattgtattgaacgcatttgcctagtaatactatttttttacccttcacgattttaattttgaggttataaagtttaaagagacttttttgtccgtgaaaagatgtatgtataaactaaactaaactattactaataatgaaaacctctttggagtttattttttgacaagttgagattgacattggaaacaaagaattactggaaccgccttactcctctattattacttttcaaccaattgtttctcagaagattttatcttaatatcagtttttgagaaaatgaagattgttggggaaaaaatacgatactgcatattttgaaattttgaaaccgtttccttttgtacacgattattgcgctaaggtttttcaatgggttctacttgttcgtttttgaactttattttttggttgaacgaaagttgaaaattgaaaatccaatgtttttatgcacaattgaggatggcgactggtaaacgacagaagcatcaactccatttcgtctagtgtatgtgtgaaacctgtcatctgtgaagaataggtatattgtttagcaacgagaacaactaacgttggtattccttagaaagcgaaactgatagtgtggctagaaaatccccacattgttcacatctttcaagccttcgtttagtactacattgttcatcgcacaataataatattgccgataatctcataactgcagcgttccacagcaatatataggcatatgtgaacgatttttgccgagttacagttttattttcagcccacattcgatattacatcactgttccccttcattgtctgtctgctgtcaaaaactaaaacttcatagaggttaaagaaagttttgttaaaaagagtaagcataaaccgaatagtacgtttgctagtttctttttttcagaaactttctattattatcattattgtaacattgatcaaattgactaacttaactctttacagactgttcccggttttagctagacattctcggttcattccgctcgccaacaaatttacagttcattttagcatattttcaccaagactattccattctacacgcaatatattaagaagcaaaatgagtgaggaaaatctttctgaggtttcaatctctcaaagtaaacaatacgaaattactgaatatagcgatagacattccaagttggcttctcatttcattggtctgaacactgtggataaggcagatgattctccattgaaagagtttgtcaaatcacatggtggtcatactgtgatctcaaaggttttgatcgctaacaatggtatcgcagccgttaaagaaatcagatcggttcgtaaatgggcctatgaaaccttcggcgatgaaagaactgttcaattcgtggccatggccactccagaagatcttgaagccaacgcagaatacattcgtatggctgatcaatatatcgaagttcccggtggtaccaacaataacaattatgcaaacgttgacctaattgttgaagttgccgaaagagctgatgtagatgcagtttgggcaggttggggtcatgcttcagaaaacccactactccctgaaaggctagccgcttctcacagaaagattatatttattggtccaccaggaaatgccatgagatctctcggtgataagatctcgtccactatcgttgcccaacacgctaaggttccttgtatcccatggtctggtactggtgtcgatgaagttcatgttgataaagaaactaacttggtctctgtcgaagataaagtataccaagaaggttgttgttcgtctccagaagacggtctaaagaaagccaaggaaattggtttcccaattatggtcaaggcttccgaaggtggtggtggtaaaggtatcagaaaagtcgaaaatgaagatgagttcctgtctttgtaccaacaagctgctaatgaaattcctggttctccaatttttattatgaagttggctggtaaggctcgtcatttggaagttcaacttttggctgatcaatatggtaccaacatctctctatttggtcgtgattgttctgttcaaagacgtcatcaaaagattatcgaagaagctcctgtaactatcgctaagccagataccttcactgaaatggaaaaagcagccgtcagattaggtcaattggttggttacgtttctgctggtaccgtcgaatatttatattctcatgatgaagacaagttctacttcttggagttgaacccaagattacaagttgaacatccaaccacagaaatggttactggtgttaacttgccgtctgcccagttacaaatcgctatgggtattccaatgcacagaatcagagatattagattgttatacggtgtcgatccaaaatctgcatccgaaattgactttaacttctctacacctgagtctgctaaaactcaaagaaaaccaactcctaaaggtcactgtactgcctgccgtatcacatccgaagatccaaatgagggtttcaaaccatctggcggtgctttacacgaattgaacttccgttcttcttccaacgtttggggttatttctctgttggtaataatggtggtatccattcattctctgactctcaattcggtcatatcttcgccttcggtgaaaacagacaagcttcaaggaaacatatggttgttgctttgaaggaattatctatcagaggtgatttcagaactacggttgaatatttaatcaaattattggaaaccgaagacttcgaagacaataccatcacgactgggtggttggatgatttgatttctcagaaaatgacagctgaaaagcctgatagaaccctatctgtcatttgtggtgccgctaccaaggctcatattgcctcccaaaaagccagagaagattacatctcatctttgaagagaggccaagttccaaacaaatcattactacaaacaatgtacccaattgaatttattcatgatggtatgagatatagatttactgttgctaaatcagccgacgatcgttatactctattcattaacggttccaagtgcgaagttggcgtaaggaagttatctgatggtggtttgttgattgccgttggtggtaaatcacacaccatttactggaaggaagaagttgctgctaccagattatcaatcgactctaagacaactctactagaggttgaaaatgatccaacacaactcagaactccatctcctggtaaattggtcaagtttttggtcgaaaacggtgatcatgttattgctggccaaccatatgccgaagttgaagttatgaagatgcaaatgccattgatttctcaagaaaatggtgtcgttcagttattgaaacaaccaggctctactctggccgccggtgacattctagccatcttaactctagatgaccctagtaaagtcaaacatgctaagccttacgaaggcatgctaccagaattgggtgctccaatcgttgaaggtaccaagcctgcatacaaatttaaatctttggtcactactttggaaaacatcttgaagggatacgacaatcaagttattatgaatgcttcattgcagcaattaattgaagtgttgagacaaccagaattaccatactctgaatggaaattacaagtttctgctttacattcaagattaccacctaagttagacgaaatgcaagaacaattggtcacccgttcattcaagagaaatgcggatttcccagcaagacaactagaaaagatgttagaagctgccttaaatgatcctaacgttgacccattgtttagcactaccattgaaccacttgttgatattactacccgttactctaagggacttgctgctcatgaacattttgtctttgccactttcttagaaaactattacaatgtcgaaaaattgttctctgggccaaacattcgggaagaagacgtcatcttaaaattgcgtgatgagaaccctgacgacttggagaaggttgttttaaccgtcctagctcactccagagtatcagccagaaacaacctgatccttgccattttgaagcattatcaaccgctatgcaaattgagctctgaggtagccgctgctatcgaacaaccattgaaacacatcgtcgaattagaatctaaggccaccgctaaggttgctctacaagccagagaaattttgattcaaggtgctttgccatctatcaaggagagaacagatcaagttcaatacattcttaagtcatctgttttaagcacttcatatggttcatccgaaacgaagcgcacaaaacctgatttagaagttttaaaggacttgatcgattccaactatgttgttttcgatgtgttggcccaattcttgacaaatccagatgatgccgtttctgctgctgctgccgaggtctacattagaagagcatacagagcgtacactattggtgatttgaagcatcaaaagtcttctggatcacctgtagttgagtggaagttccaacttccatctgctgcattcacctcattgccacaggttaagagtaaattgggtatgaacagagctatttctgtctctgatttgacttatgtctctgacggtgaaaaccaaccattaagaactggtttgttgattcctgctagacatctagatgatgttgatggtattttgtcgtcagctctatctttaattccttctcatcatatgtctactggccctgtcccagacagatctggctcttcagccagcttgtctaatgttgccaatgttgttgtgtcttcaactgaaggatttgaatctgagtcggatgttttaaagagactcagagagatactcgatttaaacaagcaatcattagttgactctgctattcgtcgtattaccttcgtgtttggatacagtgatggtacatatccaaagtactataccttccgtggtccaaattacaatgaagatgaaacaattcgtcacattgaaccagctctagctttccaacttgaactaggtaagatgtcgaacttcaatatcagacaaatatttactgagaacagaaacattcatgtctatgaggccgttggtaaaaactctccggttgacaagagattctttaccagaggtattatcagaacaggtcgtattagtgacgacatttccatccatgaatatttgacttcagaagctaacagattaatgagtgacattttggacaacttagagatcattgacacttctaactcagatcttaaccatattttcattaacttctctgctgtatttgacatttcgccagaagctgttgaagctgcctttggcggtttcttggaaagatttggcagaagattgctcagattacgtgttgccgctgctgaaatcagaattattatcaaggaccctcaaactggcaccccggttccaatcagagcgttgatcaacaacgtctcgggctttgttgtgaagactgaattgtatacagagatcaagaatgcacaaggtgaatggattttcaaatctttagataaaccaggtgctatgcatttgagacctattgccactccttatcctgcaaaggagtggttacagccaaaacgttacaaggctcatttgatgggaaccacatacgtttacgatttcccagagctattccgtcaagccaccgtggcacaatggaagaaacactctccaaagaccaagttgtcagacgattttttcattgcaaatgaattgattgaagatgaaaatggtgaattaactgaagttgatcgtgaacttggtgctaataacatcggtatggttgcattcaaggttactgcaaaaactccagaatactctcatggccgtcaatttgtcatagtcgccaatgatatcactttcaaaattggttcgttcggtccacaggaagatgccttcttcaacaaggttactgaatatgcaagaaagcgtggtatcccaagaatatacttatctgccaattcaggtgcaagaattggtattgccgaagagcttgttccattgttccagattgcttggaatgatgaaaaagatccagcaaagggtttccaatacttatggttgtcagatgagtctcttgaagaactcaaatctaagggtaaagacaatgctgttgttaccgaatgtgttgttgaagaaggtaaggtcagaaacgtcattactgctattatcggttcggaagatggtcttggtgttgagtgtttgaagggatccggtttaattgcaggtgccacttcaagagcgtacaaggatatcttcacgatcaccttagttacttgtaggtctgtgggtatcggtgcttatctagtcagattaggtcaaagagccattcaaatcgaagcacagccaatcattttaaccggtgctcctgccatcaataagcttcttggtagagaagtttactcttcaaacttgcaattgggtggtactcagatcatgtacaacaatggtgtttcacacttaactgctccagatgatttggctggtgttgaaaagatcatggactggttatcttacattcctgccaaacgtgatctaccggttcctattttggaatctgaagataaatgggacagaaaaattgactatgctccatctttaaacgaacagtacgatgttaggtggatgattgcaggtcgtgaatctgccgatggtttcgaatatggtcttttcgataaaggttccttccaagaaaccttgtctggttgggccaagggtgttgttacaggtagagcccgtttaggtggtattccattaggtgttattgccgttgaaacaagaattgtcgaaaatttgattcctgctgatcctgctaatcctgattctaccgaaatgttgattcaagaagccggccaagtttggtatccaaattccgcgttcaagacagcccaggctatcaatgacttcaatcatggtgaacaattgccattaatgatcctagccaactggagaggtttctctggtggacaacgtgatatgtacaacgaagttttgaagtatggttctttcatcgttgatgcattggttgattacaaacagcctataattacatacattcctccaactggtgaactaagaggtggttcttgggttgttgttgatccaactatcaatgctgaccaaatggaaatgtatgctgatataaactcaagagctggtgttttggaaccagaaggtatggtcggtatcaaataccgtagagaaaaattgttggctactatggcaagattagatgacaagtacagagagttgaaagccaagttggccgattccactttgactccagaagaacatcaagaagtatcaaagcagcttgctatccgtgagaagcaattgttgccaatttaccatcaaattacagtacagtttgctgacttgcatgatagatccggtcgtatgttggcaaagggtgtgatcaaaaaggaattggactggccagaagctcgtcgcttctttttctggagattaagaagaagattaaacgaagaatatttgatgagaagattaaataacgagctaggatctgcttctagactagagaaaatggcaagaatcatatcatggtacccagcttctgtgagccaagataacgacagagaagttgctacttggatcgaagaaaactaccaattcttggatgaacaagttaagagtctgaagttggaagctttcgcacaaaatttggcaaaatctatcagaaacgaccgtgaaaattccatcaatggtttggcggaagttttgaaattattgtctgccaaagacaaagaaaagcttcaaaaagctttggaatgatgaacttttaataccagtttaaattagccaattttctctcttcatagaggttttagtatttcatgtcaaaaggactctcaaaagatattagtgcttcagttttttctgttgttgtttgttgaactgatgttacatgagtgcctttagaggtccttatgctatgacacatacttaacgtgtacaatatatatatatatacgagctaataaagatatgattgatatatgtgaaacaaatgaggaactttgaggaattaaagtctggttatattatccagatttcattttcttgttctgttcatccgatgtgagttctgaagctctttttcagtcagacgtcttcgtcgatttgagattgttcaatctctgtttctcagccatttccttttcacgttcttggattaaaaatggtattggatcattcaatgcaccgccactagaacctaattgctgacaaacatgtgcaaagtcagagagtttacggcattgtgtaaagtattgatagaatggagatttcccgggagtcattctattcatcatatatttaacatttgcaggatgatggttgtattggtttgctatatccaggtattcttttaccgctttgaaccatggcaatggtgattcagaaaaaactgttggatttctctcagcacaatccgccatcataccaccaatagttttaggtaggttcagatcacttcgtagctgttcgaaatgttccttatccctgatagcaccgttcattattaacgataccttattacgttcacatatttcatatatttttggaatatatgcccggattggagattctctgtttctcatcggggtagttctacaatgaacagttaagttcgtgataccagttgcacataatttttccaccaaagtcaaagtatcttcttcatcttttaggattctaatcttcacggaaataggtttcccataaatcttcccaactttctcaactaactcaatcaaaatggagcataatttatccggagtctgcaatagagctgcacccattccagaatgaatggagaaatgtttaggacatcccgcatttacatcaataccagcaacatcctcaataaccttgagagcggcttcgacagcgagcgatggagttgatgttccgatctgaaatatgagttttccatgctctacttctggaactgtcctgaaaaccacaccaggttccgttccctcccgtttggcaggaataataaaatcgacagtcttcaatgtatcattaacctgtctttgacactgtataagtttcttgtcaatgatttctggggaccagaccaaatctgcgccgtgcttcaaggccaacaatctcgttggcagttcacctgccctgaccataggcgcaagcactaactttcctgcatattgtaccattttaattaccacgataaatccactaggatcctactctcagaagcgtatatagtctacttgatatcacttgatttgtcaaagctcatcacatcttgtcatacctcatcgcatcttgaatcaacattttttttcttcatttcattccgatattcaaaagtcacgtggtaccgtttgattctgttagatgcttcattccctaccgatagatcagctattaagatatgtgaacattcaacacaggaagacaacacatatattatgaaacaatacgacccaaaatattctgtagtgcattctcagcctcattggttgtcataacacttcttcatgtccagttggtaaacaaacacaaaccgagatattttgatccaccttgctacacctccaaaacgcgaagtttcaaatttccttccctagcagcttaccttagttacgcgagttcagtgaaaaaaaatgcctacgtaataaaaattcttattgcaggaccagatctgaaacatatttgaacggaatgcaataactgcacaaatagttcacggtatgaacgtttaacgtgttgtttgttttgatattaggttatgttcatgtcggtatataagagcttcatctaattgggttcgtaatttggtggttgagacaagatagatcagataactaacgctcattgaaccgattctaaaatagaagtcaatacaggaatagaaatacataccgagtgagatattatgttaaaagtacttagaaaaatatccggccattcaagtgatgctggtagtgagaaaccggcttctgctagacggaaagatgtaaataaggacctaaggaaaccgtatgatccgcaaacttcacaatacccacgccaggctcctgggaaagcacctttaagacctggcaagccacaaggtggtaacggtgctaaaccggaaactggtgtaacaggaccatcgtcaatctcttataataagcaaagacagaattattctgtgctggggagcagcaatgacagtaatgcgtcttctcatggatcaatgtcatatatgggtaaagacactcacgagagcttaataaaacaaaatcgagtcaacagaaaaagaagtgaacattattacatttatgactttgaaaaatataggggacccacggatgagaccattgcatcagatcccgattatgacatctttcaaatcaaagatgggatcagtgcgtcttctgctagatatgttatccattatttgacaaacaatttcaaagaacagctgttgaacagattttcccaccaaaataacaatctagatacggatgtgttgaaggcctcgatggaaatctttaagcctaatttgtcgcatttttctagctccgagatacaccattgtaaaaaaataataagatctttctttccttggcaaggatgctccttaactggaacagcgcttgaaaaagcaattgctgaacattacggggattattcaaatccaaagcattggacgaggttgatactgtcactaaggattatatggtctcacctttcccatgggattgtgccatggaaatgctatcaggatttttgtcagcttgaatcaaggaacaattatcctacgatgtctttttataaccttttacctcaatgtcttcctaatcatgattacacttgcagtacgttcgagtttttagaagtactagtagctattatttcgaagattgatctcgtagttgacaaaaacgcacaaatggacttaattttcactgcgggacaggtatgctttgtaaaagaccaaaatctacaaagacatttacaggataattccaagaatgatccggatttgatatctctagggaaactgtattatgctagaggtactgcgttacttcatttgttcgtcgcttatttgagatctttggcggaggaaggaaagatcaaagacttttatctcattgataacttccatattgacaattatccaccacatccatataaacctgtggcacaaactgccttaactttgactgttccgtcttttattgacggcgagaacgactttaataccttacttaaaaatgcagcaaaagcacaatcgagaatatattcttccaaccattccttctctaagcaagagaatgcatttttggataaattcgaagaaggtccatacaaagtgtttgataccctattctccagatcatcaaaacgttacctttacaagtttgataagaagtttgatccaaattctttaaaactctcaagtgaatctgggatgcaacaaggtttaggaactataggcgaaaacgatcaatatgccgtagcaacatggattgaacattgtaaaggtcaagattttagtgaatttttaaacgtgttagacgatagcggtcttggagaaggaacgttagcgttcgaccatacttctttcaattttgccgctaagaagcaaagtcaaaaggaaaacttctcgcctgtgagagtttctaaaatggctttgtctgaatggttcatttcatcatggaagtacgaaaccttccttcacaaggtgcataacaccttactaatcaagctaacaaaacgagttggtgattgtgactggttagttctaagtactgatgaaagagtcggtaagtcgagctacctaactcctccctcttcgagtgattctgcaaaagctcttgaaaatgtcaaaatcccggccattgattccgataatgcatctattaaatctcgtcccccaccaccaaaccttttgggagataaatcttcgtcaccattattggattcgccaagttcttccttgtactctagcgtcttaagaaagcctgtaaaagaaggtatggggtccgaacagaaaaatccctctgcttataaccgaaactctaagatgagcgttgttactgcggctcctccttcctcggtttcaagaagagaaataatgacacccgttgaagataatacccaaagtgtctttcaacatgactatcccaataatcaccacctgcctcctgtcatggtgaaaatcaataacccatctttagtagaccttgacgctaatggcaaaacttacactccatctagatctagaactcttgcacccgctgctacaccagagcaaaatatgaatatagataaatttggttcgatgctgtctgatcagcaacgcctcgttaaaccattggacttcagtgttaagataaaatcaaccgtcatagaggaagaagattcccattcaactttgcctgaggatgatggattggaggttgacgaagacgatagtttgataacgacaaacacaatacaaaagcttaaagcacaactctccaatatttcatcggatgaagaggaagaagatgcagtggacgctgaactggaaacaggacaagaggatgaagaggagcaggaacaggaggattcaacacaacacatggactctttagaagtccaaaatgtggttgacaatgttatagaaacgaaagaaaacccatgtacggatcgtcagttttcagttagcgatgcaaactctaaaagtgatgttcctgccttgcagaacgaagaggtatcagttgacactgcatctatcgccataaattctgtggaaattcccagtacaccggctaatgatacagaaacttctctatcatcaaaggaagcaaatattgaggaaagtaaaccagagaaaattcttgaacaaggttttgaaagcgccaaaccactttctcaggatgagcaaaaaagggtcagctgtgatacagcaggttcctttcaggatgcatctagcgtgctgataagagatgatagtagtttaaactccgaaacgcacaacacaggtcaagaggatcacaatcaatcatcagtagcaactacggctggatctgctgtgaccgaaaaacagaatgttgatactgaaattgggagtgacagaaactccaaggcaatatcagagagtgacaaaaacgatgaagcaactagcaagagtatatctctgactccaaataacaggcttatgcgagcctctgctcttatagaaccacagtcttctccaaatgatatactcaatgacctgattgataactacaatgcagaaagtttggtcactgttagctcagagggcgcgactttgttcgaacggataaaaagtcaaatggaaagggtaagcaacggtaaagatctgccgccaattccggccacgaggccagtcctgcataaactgaaaatggatgttgtgaacgaagaggataatgatgatagtccttcatctgagagcctacccttagtgactccaactaaaggtacagcaacgataatgagcggattttcttacaatgcaacacctccgatgaaacaggaagagttcaaatataatggtaagctgacttttccccaagattctgtaaacactttctattcatctttggaccacgacaccgatacgaatgatcacgacggacaagaaagtgcaggcaacggcgacgaatttctttccattgaaagcgcggacgaaacaacggacattaacgaggaaaacaaggcattcaggaatgtcatgctaaaaactaagaaaagctttaaaagcttgaaaaataaatcgttaagggcatgagtagactatataatctacatctcgtatataagatttaatctcttattaaaagaacagaatccgaacaccaagtaccagtgtatggatgcatttgaagttaagtagcgagcggaaccatgcaggagcggcaaaaggaatccttgcattctaaagcgatcctcgaaagagtaaaaccttaatcggagctttacaggttttctagtgatatttgccgagagaagtgtaaaacatgttgacaatcataaaagaagagtacatgtgcacattcacaggtctaaagttcttagggtatcaaaaaaaaaaaaaacatttcgacaaagctggagcaacataatctcacttgttcttagacttctttcatactgatctgtaacgcggtttctggaacttgaccgctagagaattccttctatggtgatgatttgtgcatggagaagacaaatcgagtgaacattgcgaagaatcatcttcagtgcatttggtggggaaatcgatcttgcatgcgtgcattgaattccttggagaaacaggttgtttttcagtaatggaccttgattcagaaggcgaattgctattgtattcgtcattatagtcgtaatcgtaattgtagtcgtaatattcattgctagttttttgcttgtcatcattatcctgattgtccgctagagttagcgaacctgtattttcagagtaactggtattatctacactgttctccatgctataatgctttctgaaggggttttctggggtaaattcagacgtctctgactccattaacgtaggtaacacctcagaaccaaaacccaagccagcacttgagcaagaagccgttcttcttgaccgacacttgagcgaaggacttgacaatgtggattctgatgcgggacgctggattgaattctggtgatgcccctgctgttgttcgcgtaactctagataatgaccagggagtcgtgtcaaattactttcgctgaatctccgtgcacaagcaggaacatgtacaaaccagtcgtcatgatgatgataatgacggctatgtacgcactggtacaagtcgcagaccttcatgtttttggatatttccgtttgcaaggaaggattctgagactcctcaccaaatgcgcatgcgttaagtggttcgaaatcgtccactccgtcaggatgctgttgaacccgcaacaacgtcccaacgatctttgaatcacctggtttcccgttcttagaataatgtacttccaactgtgccgtaataggtctattcgttcgatgctgatccatatcgtttaaaaattattactatgtcgcaatcaatccttgtatattatctgggtattaaaacatctgtatgacgttctttactctcgttgcacaattctaagaccgatctaccataaatacatattcaaatatctaataaagtcgtcgcagatcatcagaagttcacatttatataactcataatattctgacgccatatatatatatatatatatatatatgcatataggcaaatattattgtcatgtatacagatagataaacgatcccacagcaactcaaaactccacaaacattaaaaagtgggagaccattccagcaaaccggaaagactacggaaaaattatcttgaaacatactttgtcgacagcaagtggctaaaacgccaatgcaccaaaacatataattcaatacacatacacacttttagtcttacattatcaactgtaatattgtcacaaaatacatcatagatgcttagtagatgcttaaaaatgaaaagagtctggacttcaaccccagttcgtctttcttatcttgcttcgttgcctgaagctcgtatattccttgctgctgaattgaatgaatgatccagttttgctggcctgatgccggaaagcaagccgtaatagcaggctatagctcttctgacttccttaatggatggtatcatcacaatacgcgcagtcaccccattttgcagttgcgattttcgtttcatttccctttttcctttttttccctaattttccaaagggaggggccttgtggagcttattttggtacataaactgcatagaatagtgcgtagggaaatttcaagacgatccattttctgatccgttcctggtttcgaaatacttgggggccgtgggtagcagcaatcagcgaaacccatggttattatatttttacgagaggtaagttggtttgtgtcacgtgtatttttacccggccacgtgttttcctgcgctttccctttgtctcgctggagacagccaagtaatctacgggaagcatttatatagtatgtattattattatcacaatgcgaataatcttaaatcacacggtggtttatttaactttgtacagggcttccctttcaataccaccaggatacaaatatagcaggttttgtttacagtcgataaaagtcaggagagcttttttcaaactggtctgaacagggtcataatctcacagtaacaagcacacaaaatataagctttggattaatttccccccattgttactgtttctgcgtttggttccaccgtttgaaataaacgaagtactgttccaatatgaagttctctcattccttgcagttcaacgctgttccagaatggactaccaaatatattggttattctcagttgaagaaattgatctatacattacaaaaggagaagttgtatagatccacttctgaaagttctgacctggaaagtaccccactgactaccgctgtcacgagggattcttacgaacagagatttatcgatgcgttggataaagagttggacaaaatcgactcgttttataccatgcaggagacgtcgatcttggccaattactctgaagtgtatgaagacgtgactacgttccagaatgaactgatgaacagatcgatacataatacaagcactggtgatctgaacagacagggaacaaggcgatcatcttctatctctgaatacaattcacagccagaaatggatctttattctgaggaagacgatgacgaggacgggttttccattggaaaccaagagcagtctgatggtcagaataagcagatccaggctcgaagagcaagaactggttcagtaggatctaggctcatgcattccattaccagtgaaatacttccaacgctgtccagggtaactgatttcaccactactgatcctattatggaacaacagattactttgaagaagagaatcgttgcctgtttcactcaactttcagaattaaaatcttttatcgagttgaatcaaactggttttgccaagatctgcaaaaaattcgataaatctttggatagtaatatcaagaccgattatttaaagagtttatcaaagaaatcgcatgtgttcaatgaacacaccattgagaatttatctaatgacatcaatgaagtcatagtcatgtatgcaaaagctattggattaatggaccctcaacatgaggtctttaacttccaagaagctgaaagagagctttcccttcatttgagagaacacgttgtgtgggaaagaaacactgtgtggaaggatatgatgaatttagaaagaaaggctcaaaatgtcaaagctgaaaaggctctgaagaaagcttctactgttaccttcagaagtatcacgaaagatacggaaggaaatatcgaattgttagactcgaatgaactacaattccctcagacagtttctgaagttttcaaactatctcctctgcaatttataagcttgcttatttcttcaacacaattgataaaactgatcataattacctccatattcgtgacattgttgtttatatctccaatgagagacactttgcagaagaactgtttggcaatcttgatttacgcatctttactttgggcaacagaaactatacctttattcgttacatcactcttagttcctttattaattgttgttttcccagttttaaaggatacaacggatggacacatactaaacccaacagaatcttcccagtatattttgtccacaatgtggtctagtgtgattatgttattactaggtggttttaccttggcagcagcactatctaaatataacattgctaaggttctatcaactcacattttgtcgtctgcggggacaaacccaaagattattcttttgacaaatatgggtgtggctttgtttgcatcaatgtgggtatccaatgtagccgcgccggtattgtgttattccattattcagccattattaagaactttgcctaaaggcagtacatttgcaaaatcattgattttaggtattgcattggcatccaatattggaggtatggcatcccctattgcttcccctcaaaacatcatttcgataggtatgatggatccgccaccttcatggggccaatggtttattgtatcattacctgtttgtgtcatttgtatcgttgtcatctggtgtttactacttttgactttccctccggacagcaatttgaaaattttgaaatatcatccaatttcggatccattcactgtgcagcagtggtatatcacgatcgttaccatactcacaatcgtattatggtgtttagctaaccaattgaaggatgttttcggagagatgggtatcatttcggtcattccaatgttgttgtttttcggaactggtattttagattctgatgatttcaacaatttcatgtggactattgtcattttagcgatgggtggaactactttgggcaaagctgtcacctcttcaggcttactctcaactattgcatcgataatcaaagagtcaattgaaactaaaccggttttccaaatcgtattgatattcggcatcgtcatattgactatggctacttttgtctctcatacagtcgctgctatgatcatcgtcccattaatgaaagagatcggatcaaatctacctggtggagaccattcaaggttattaataatggttgccgcgttcctatgttcagcagcaatgggattacctacttccggtttccctaatgtcactgcaatttctatgattgatgatgtcggtgatcgatatttgtcggttaataactttatcaccaggggtgtgccagcaagtatcgttgcatattcagttatcgttactgttggctatgccctcatgaaagtaataggatactaatagtcggatatctgtattaattttctttttttaatatttagtatgttcttatatttggcttcattctattactggtaaagccgtaaacccttacacttccttagttcctttcaatgacagtcgataactggtaagaatttgaaactactacaattgcagatacttaggggaaaatattagttatgcattacaaattaaaaaaaaacaacaaaacaggaaggactacttgcacccaaagtaatttgaggcaacgaaccgctttctggcccaattacattgattagttctgattttgtcatcggaaataatttctccagcgtatatttcaacttgattattagtagcattaactatccttctaataccggtttctgtcgctagataaactacaaccttaatcttcttgagatcaacattgtggtcagtaagaacttggattgccatgattatcgctgcacctgaaattatctgcgcatccatcagtagcacttggttataattttcgatcattggtggaataaataaactgtgcaattgtggttcccctgttctggaatcggattgaataagtagcttaccaactgcgacgctaggaattgtctttcttagagatctcatgaaacagtcgccagatctaacaatatttatagctgtgacacggtcaaagtcaacaaaaactggattatccaactgttttcctgtcggcgtaataactttagtcgttttcaatttcgtaggtatatcgtccaatgcaaaggataaaagtattgttgctaacctgtcaaaatagaatacccagtcatctcttgaaacgcttttgtctaacaatatagtctgtagagccttcacctgattagtttgtctcaacttatgaattatatttaaagaatcaatcgacacagcgtatgactcgagcttttgaagttctgctaaatgctgctgcgatttgagctgcaatttagactgaatgtgattaagtaacatctcagtcgcaatgctgttatctgacatggatgggatgattgcatctgctgccttcatggttggtttcacgaacctatccgcatttggtttaacaaacttctcccattgtcttatgcaaccatgcaagtctctcccacgagagatgatatcccttgtcaatcttctagctaaacatatatctaaatctgcatccacgtaaaccttcaaatccattaaatcaagaagtctttggtcatataatgcgtaaattccttcaataacaataacactcgcaccatagatggttaaaaacttatttggaattctatcatgatctgtgaacgaataggttgggattttcaccttcttaccttctttcaaagacaggatacattgataagctagatccaaatctattgaatccggtttatcgaaatcgtagttattttcgaaagcctgctttcgttcttcgacggttaacggtttatagaaattgtccaacgatattaatactgtccatggagtgttgattcttgtcacgagtttggtagcaacactcgtctttccagaacctgaactccctccaataccaataacatacggtgttgtccaaggtggtatatagccagaagagttcattctggacgccttgcaagcgttttatgaacactaaatgtcctatgcctggaactgtctatgtctgttttctgattcagataatgtttatctggaaggtttctatcagtcatttggcatagttttcaacatttgatattgcaagaaagccactcgatgtacctttcacgattagaaactaaaggtgagggaagaagaagaaataagcgctacgaaatcaggtagaacgctctcgcagcataccgaatcgcagttcatactatgggaacctcaggtgatgaaaatggtactaaacttacgggatcaggacagcgcagagcgaagagaacttatgaaagcatagaatcggtaaatgcaaatactaactcattctcacctgcagatcaagttttggacagtagcccggacccttcattgaaggatggtaaggctcattattcggttaactcgattaagtcaatggttgagcaaaaagttttgactaagagacagcgttctcagttgcactggctggttaaagatcttcagattttagaagatgacataaaacgttatggttggaataacttaactgttagtgaacgagaagagatatcgctgaaaagagagctattgaagctcttaaatgaaactggaaaagactatgctgaaaatggagatacaagtggattcaaaatgcaagatgaggtcgcatcaaagaaacaactattgaccgccaaacttcgaaacaaaaccgatagggtgaactgggaagaggagcaaatgaagaaaagtgtaattaaggcagatgcagatgaaatcaaagttaaggattcagataattacgaatttgtttttgatcctgagtccatgattgattttactgatgatacgacagatattttagaacctgttgaagacggtagattggctgaagcgttagaagaacaaattaacaagatgaagagtattaaagaaacgaggaagtcattgccagtttatcaatatagacaagaaattttggatagtattcggcaacatcaaattttgattgttgttggtgaaacggggtctgggaaaaccacccaacttccacagttccttgtggaggatggttacaccaacgatggaaaatgcgtggtttgcacacaaccacgtagagttgctgcaactagtattgcttcaagagttgctgatgaaatggatgtaatattggggaaagaagtcggttataatatcagatttgatgaccgaacaacgcctgataaaacaatcttaaaatatacgacagatgggatgttacttcgagaatttcttaatgacccacaactatcatcgtatagtgcaataatgattgacgaggctcacgagcgcacgttatctacagatattttgttggggttgctaaggggtattttacaagacagaaaagatcttcgacttataatttctagtgcaactatgaatgctactaaattctccaagttcttctttgattgtccgatatttaatgttcctggtagacgctttcctgtggatattcactatacacttcaaccagaaggaaactatataaatgctgcgatcaccaccatctttcaaattcataccacccaaaaattaccaggtgatattttggtatttctaactggtcaagaggaaatagaatcgatgcaaacaaaattacttgagattctttccaagcttgataatacaaaatttccagatctcttggtagtacctatatatgccaatcttcctcaagaacaacaatccaaaatttttgaacctacaccgaagaactgcagaaaagtagtgcttgcgacaaatattgcagagacatcgttaacaattgacggcataaagttcgtggtagatccaggttttgtgaaggaacaatcctattcaggaggagtttcaaagctagtgacagttccatgttctagggcatctgttgaccagagagcagggagagcagggagattgggtccaggcaaatgttttagattatttacaaaatggtcttactacaatgagcttgaaaaagtaccaaagccagagattttgagaacaaaattgaatcaagtggttctacttttgctttcactaggtatcaacgacttacttcactttccaatgttggacaaaccaaaaactatccagctaagcgaagccctcgaaaatttgtatgccattggcgctctcaatagcagaggtgcaatcacaaaagtaggacaagttatgtgtgatttcccatgtgatcctgaatatgccaaggtaatatattctagcgtgtttgaagaaagctgtaatggtgttctacctgaaattgttacgattgtctctatgcttcaagagagcaactctatatttgtaccgggactcaattcggaagaaaagacaaaactttttgggtcattgatgcagtcaagtgaccacatgctatacttgtggatatatgaacaatgggaagagaatggatactcacgaagatggtgtcaagatttcaagttgcaacataaaacaatgaaacgagtattgaggatacgacaacaattatggaaatattgtaggaaacaagattttctgcttaagcatgaccaaaaccttactcaactcaaagaaaacatgcctcgttccgtcattgaagcaaaaatcattaaatgctttatatcaggatttccaacaaatatagcaaagctctctaaacaaggctatactaacataaagcaagatttatccgtcagcgttcacccatctagtgttattttcaaccgaatgaaacaagaaggaaaaccaatgaaatacatcctctatcaatctttgatgcttacaagtaaagaattcattagagattgtataacatttgataaatacgaatggctcactgaaactatgccacatatttataaatgaatctttgtatccccagttaattgaggagtaacatatgcaacattttctaagaagcttttcagaacatcacgccaaattgttggcgagtccacctatgttctgaaaaaccaattgtagaataatcgaaatcaaatcagttatttttctaattacttctaatgttcaacaatttgctagcttccgattcaggtgttagtatagattttttgtactttcttcttctgtattctaagggattgagataatgcgatttatggatagttattcaataaagaattcctgaaattcagtgaaagtttaaattgaacacgataagcattaaatcacactttaacacaaaccacactaaaagataattattacaacgatgtgacttacctccaagtataactagtgcgttgaacgctaaaggcgggtaaaaaatgagtctgttgcctgaagttttctgcaggaagcgttcctatcgtatgaaaatcatgcataatgatacagttctcagaaaaaacagtacaaaaacccagtttgttcagttttaggtttattttgcgagagtcgcaaagcaaagtttctgactactcttctaaatattagaaaattggaatatgtcgctttgaatctgtatttatctttgttcagtttccagctatcttccaccgctgtggatactgatatctacattctacaacaccttcaacattcagctgaacagaagggaaaatatactgagatatatcaaaagtacatccagtctttatcaagccgttctaatttgacaagataatcaacttagttattcttttcggtatatagtttaaactgtttcgccaaataaatactcttgtatttattaaaagaagaaatatcagttagactttagtaaagcttaaagttgagtgagtattttttcattagaaaagagtgagaaaagatacaaagtgagataccactatgataatgagtaggggctcgaatgcaatcagaatgctgcatcctgtcgattgcaatgaaggaactggaatgtgtcgtatcatttggggttctacgcaaaagctttaagaaaacaaaggtctcacctttccgtataacaagctcatgtgcgtcacggcagatcacttatctatcggatccaaagctaaatatggcaaatcctctgcactattaaccgtcacttttgcatcagtcaggttatgttttcattgaaaagaaactgaaaaattaatgatttctcgttgtatagcaaaataaataggattttgcgaccagccaattttgtatattaacaggagttaccttgagatgcctttttaccattggctagccatcaattcatcccaaacgtagtagttccacctacatgttcaaggaaagattactcaacatcctcaagcatatacgaccaatgagtaccgaaactactgccaaatattatccaaaaattgttgagtctgcgcaagcggaccagagcttaaagctaaaccacacatgtttcagggtaaaggatccaaaggtcactgttgcgttctaccaggaacaatttggtatgaagctattagatcacaagaaattccctgacatgaagtttgatttatacttcttatcattccctaataagcagttttcgaacaactctcaaggtgccattgacgtctttagagaaaacggtattttggaattgacccacaattatggtactgaatctgatccagcatacaaggtgaacaacggtaatgaagaaccacaccgtgggtttggtcatatttgcttcagtgtctctaacctagaagctgaatgtgaaagattggaatccaatggcgtcaagttcaagaagagattgacagacggtagccaaaggaatattgctttcgcattagatcctaatgggtactggattgaattgattcaaaacaacgaatctggagaggggaacaactacaagttcaaccataccatggtaagagtcaaggatccaatcaaatcccttgaattctatcaaaacgtcctaggaatgaaaatccttgacgttagtgaccattcaaatgctaaattcacgctatacttcttaggctacgaaaatgatcaaaaaggaattgctcgtggttcaagagaaagtatcttggagttgacacataactgggggacagaaaatgatccagatttcgcttatcacaccggtaatactgaaccacaggggtacggccacatctgcatctcaaacaaggatccagctacgttgtgcgcagaaattgagaaactatacccagatatccaatggtctccaaagttcaatcaaggtaaaatgaagaatctcgccttcatcaaggaccctgatggatactccatcgaagtcgtcccatacggattgggcgtttgaagagcaccaaactctcatctatttatttgaaatgtaaatgcaaatttatgtatcgttgtatacaatattcgatatgacaccgttcaatcgccatattacagccataactgccggtaatactgataaagatatccttttgaagtgacatgaaagcacgtgactgagattaatataactcttcacatttttttttttttaatttttcattacgcagcaaacatgcagcatccactaacttcagagattcctgtaagataagtggttcgttattttccggattccaattttggtggtgctccgaaaagtggaagctcgtgatcctacatgctcacgaaacccatcatcatgcaatccacattaaaggaagggaaaaggatattgaacttttgactatttagtataaatgaaaactactttgtaagcttggacagaggaataatttctgattcgtgcttctgcttctactgacttgcaaaccagtaaacaagttactgcattaatcagtaataatctgcgtatagcgaaacttgtaaccagtttcctcgtaacaaggttagcagaagaatttgcaagaggatcaagttgataaagacgtatatttaggtctctgcacgttttcaaacttttaagcgagaatcaaacgattacaaaaaggaaaatattgatacaagtaataataaactgcaatgacacaatctttgccattgttgaacggtacggaagcgtacaaattagttacgactcaagggttgtatgataagacagtcaagttttacgaaaagtatttgcaattagttcatgacaagcgagttggcacattgacaaattctttaatcactctaaagctagttgttgataacagcttcaagccattggatgttgttaacgataaagattggagggccattgtgtcatcagcattggttttttcatgtacaaatatccaacatttcagagatttggctgctggtgaaacgattcaggcctatcctaacgaaaccaacccaattgaaatatatttgaaggatccaaacggatatatcattggtatcactgaaacgaaaaatgctatttctatcaaacctacgctgcctaagcaatctgttgaggcctctttgatctcctcaagatcttcaagaatagacattgcttcttctggtgtttccactgacagctcgtatccagcgattccaaagactgcgaaagcgcaaaagtccatcgccgttatgacatccggtggtgatgcgccaggtatgaacgcaaatgtgagagctattgttagaacagctattttcaagggttgtaatgccttcgtagtcatggaaggttacgaaggtcttgtaaaaggtggtccaaattatatcaagcaggtttactgggaaacagtacgtaactggtcttgcgaaggtggtaccaacattggtactgctcgttgtaaagaatttagagagagagagggaaggttacttggtgctcttcacttaatcgaagctggtgtcgacgctttgatcgtgtgtggtggtgacggttccctcactggtgctgatttattcagatctgaatggccttctttgattcgtgaactcttagatcaaggaagaattaacaaagttcaattcgataggtaccagcacttgaatatttgtggtactgttggatccatcgataatgatatgtctactacagatgctaccattggtgcctactcggcattggatcgtatctgtcaagcaattgattacattgaggccaccgctaactcccattccagagcctttgtggtggaagttatgggtagaaattgtggttggttagctttattggctggtatctctacatcagctgattacatcttgattccagagaaacctgcatcatcaagagaatggcaagatcaaatgtgtgatatcatttcaaagcataggtcaagaggtaagagaacaactatcgttattgttgctgaaggtgccatttcagcagacttaactcctatctcatctaaggacgttcataaagtcttagtggacagattgggtctagattgtagaattactacactaggacatgtccagagaggtggtacagccgttgcttatgaccgtattcttgcaacattgcaaggtgtggaagctgtcaatgcagttttggaatcaactccagataccccttctcctttgatcgctatcaatgagaacaagatcactcgtaagcctttggttgaatcagttcaactaaccaaatctgttgcggaagcaatccattccaaggatttcaaaaaggctatgcaattgagagattcggaatttgttgagcatttggataatttcatggcaatcaattctgctgaccatatcgaacctaagttaccagaacacacccatatgaagattgctattgtcaatgtcggtgccccagctggtggtatgaactctgcagtttattcgatggctacgtactgtatgtctcaaggtcacaaaccatatgcaatttacaatggttggactgggttaactagacacgaatccgtgagatctctaaactggaaggatcttttgggatggcaatcccgcggtggttctgaaatcggtaccaacagacatactcctgaagaagctgatatcggtttgattgcttactatttccaaaagtatggattcgatggtatcatcattgtcggtggttttgaagcgtttgtctccttgcatcaattggaaagagcaagagagaactatacagccttcagaatcccaatggttttgattccagccactttatccaacaatgttccgggtaccgagtactccctcggttcggataccgctctgaactctttgatgcaatactgtgatattatcaagcaatctgctgcatcaacccgtggtagagtttttgttgttgatgttcaaggtggtaactctgggtatctagccacacatgccgctgttgctgtgggtgcccaagtttcctatgtcccagaagaaggtataagtttggagcaactaacgcaagatattgaaaacttgacggaatcattcagcgaagctgaaggtagaggtaaattcggacaacttatcttgaagtccaccaatgcctctaaggtgcttactcctgaagtgttggctgaggtcattactcaagaagctgaaggtcacttcgatgccaaatgtgccatcccaggtcatgtccaacaaggtggtctaccttctccaattgatagaacaaggggtactagattcgccatcagagctgttggtttcattgagtctcaacacaaggtattagcagctgaggcaaatctggatgatgacgacttcgactttgatacaccaaagatcatagcaactgcatcagtcttaggtgttaagggatctgacattgtctttagttcaatcagacaattgtacgattttgaaactgaattgaacaagagaaccccaaagactattcactggcaatcgactagaaccattgcggaccatcttgtaggaagaaaaaagctatgaaattaaaaacgtatctgcttcctcaaaattcccactgaaatggatgtatattattatgtaaactgcatttataactctcaatgacaaacgattaacatttatgacatatctagttactactcacctcctggtatcaatttataatcccttttctctggaaagagtccttcctaccctagttactcatttttatactgatcgatgcggtgcttaaaaaaacaataaataaataaaaaaataacatgctattacatacgtagtcaacgtaaacaagtgaattcaccaaaagactatagtcgaaacaggatataataggtatattgagtgaagcaaccatctggagcactgtacatttgattgtattagaaagcattactcttagctttacctttttcaaagatggccattatgggatcaccaaagaagaaatcttccggccctttccaatcactgaagaattcgtttctgcgaaataagggacagccaccacaactgcaaccctggaatcctcaggtaagaactgataacactaaaaggaaatctgtacagaggacaactttgttccgtcatgactatgtgaaggtgcgaagttggccgtccgataatccaaaaaacatcaatgtaatactgagcaagactagcttcgaaatatatgaaatagatatgggaaactcgaaagaacggatgaattacttgagtttaggtaaaaaagatcagtttgtgcatccaattctgccgaaactaaaggttggaagggtaccgtcggatcaaaaacaagaatttaaaatcatcatttccctattcaatccggaaagattctgggaagtcacatttttatccattaaccacggtcgcgtacctcgtaaagttatcaacgaccttgagcaagtgctatccaaaatttgtcagtataacaacaaagatcctgacaatgcttcactaaaagacactaagaatgatacgaaggcgataccctcgccgaagattgacatcctcgaagaagtggatgatttggagtatctattggctgagaatgttcctgaccaggagcagataccagaagcagaaagtctggaactaaatgaatcatcaaccatatcttccatcagtatggaacactcactagtacagtctggagatgtcgtaaataagacattcaaacaagcattaggaagaataaaacccattgactttaacacaagagcagaaagcagtaggtacaaaaggttcagctcttttcactctgcatttttagatgttcctcgcataagcgcagaatatcaacattctttacaagataaaagacggtcgatcagtgttccgactgcaattgattacaagtctgtttccaatcacgacatgagaaagggtgttgattttgacaaggtaagttggatggatgtcacattcgaagattttccggagatatgaccgacaatattgcaggcattgtagcagtattccaggtttttcctacatgtcaatttataactcaatgcacaaactgaattatgtatgtggcgggttctacgtacattggaccataaactcaacaattttttgtttaataatcaagatatcgtattgaatatgttatcggtatatatacatgtatgtatatttcttaagattagtgttgagtcttatcatcttaagttgaaaatatcaccatttgtattttgttatatatacttggctatgaacaagagtttgtagtttatgattaagcatataaaagtagtttaacagatatgaatgggttgggtcattaaaaacatcgcaagaaacgttttaatcgattttcgataccaattatctcttctcgtgagaggttaagtttgcgtagtttgaaggtattctgtgataagttctgtcagttggtcagaaattgaaacatacagacgaaagatattggctaatgcagagaaagtcattataacaatttcttagaggttactatttgttagtttagtttaagctggtggagcttgtagagggttaccattaatatctagaccttgttgcatcattaatagttcttcgctaccggcagtttcaaattgtaaaccggcaccaagcttgctttcattcttgaaatggtcgatttcaccacagaatagaacggataatgttggtaagatttttctttccaagaaacagccgaccttaccgtttgaatcaatggaaccacggaacacagattgtctgtattcgtacttacaacctaaagtggtagcaccttcaatggctggttggaacccaataggttggccgataactgggtccatgattggcaacatggaggcttgtagagaagtttctagaccagcttccatgtttggagacacctttctccagaaagaggcgacagcagcaccattagcttgcaattgaccggagaagatccagtcctgcttagcagaaacgaaacgtgtcatataggacacagcggcgtcagctggggacatagcttgacccttagaataaatagcttccaaaccaatagccaattggggagtaatggactgtagaatagaaccaacagcaacaccagtgaagctaccgtcacttgcagcagaaggattcaaagtcttgaaattcaaagagaaatcagaagcctggtaatcttgttccaattggcacattgttggctgaccttcagagatttgtaacgtgaccttggtgacattgttcttatcccaaccgtattgcagtctaccggacaaagacatttggttatcaacattaccttgcatgaacaagttatcgttagcaaacaaagcactgaaggcatagtttggcaaagattcagagcccatggagaaagtatgagaggtttggaaagctgggttgaaggcaaaagtcttgttcaaatcggctctcaaaccggtgaagaaatattgtgtcaagaaaacatcacgagaaacttctttgttcaagttttcaacggtaccaggattcaccaacgaaagagtttttctatgagcatggatgttgttataagtatcgatcaaatatgatgagattgggttggaagaccagaaagattcacctctttgttctggggtaattggtgaaatacctggcagagtagagatctttgaaaaatcacctagaggtactggagaattagacatattagcgtgattggtaacggcaaaaagtattacactaatcggaatatattattctttagaattgtcgaaaccttgtggcaagtaaaacgttctctgtcaattattgctaaaaggtgttaaaatccaaacaaaaaaaaaggcaacctgtgtagataactcgccagtattctaaagtaatatggttgaatagtagtactatgaacctatttattaatttcaatccgttcgcaaacacaaatggaaccggaattgtctaataacaattgtactatcgtctatggttgtaacttacctcatttatattctttcgattgattattttattccaaactcgaaaattttcttgatcataggttacggaggtcacgtgaaaataatctaactcttcaacaaagacctcattcgctgtacgtcaagtaggatattgatattaatagtgttacatagcatttgcttgtgaggatgatgtgtacatataatggtcgaaatcattgtttctgaatactttctcgcagtcgttgtaggtgttttgtctttttttcaagttcaatcttcttttcctgtatatgcagttgccattgttcgggagtctttgagactagctcaatggctgcagggtcttgctgaagtagagtctttgctgttttcaaacgatgccttatactcgaagtagccgcatccagcgaatttgaactgttatttggatgcttactaatttgtttcaaagaatggtaaaggagtggtataaattcagtttgtgttgatgaatgtttcgtgagaatttcatgaattcgtttcaagacatttagttgttgttccccggaactaggttcttgctccttctcggtatcaccggtcatattaaatcgttgattgggatgggttggaagccttctttttttttactattcctcgttcccattcgactattattgagaagtcttcgaagatttcgttaagccttaattttttggatatatagccaacagataattttatgtagattgacaatgataatataaagtgaaccgagtacttatatcaatgaatatgtgtgttttactacatgctcttgcaggaaatatctactttaaatataattgtacgtacaggcagcaagttcagcactttccttctttaattcaaaacttgtgattttggatcaaattcttgatcatatctcttgcagtcaaatacaccgttctgtataaggtgtagatgtctaaggtacttgagaaagtgtcgaggaatccaaatggtagcatggctggaatccatccctgggccaattccaaagcaaaggatccgcttggcatggaatattgcttggcataaccttttttcaagtgatgagtttgacctggtttgtaaatttcaggttccatgttatatggcaaactggccctctgttcaccgtaaagaatggtgaaatggtcatcagcaaagtgtacaccggtgtgaccttcagtaccaacggcactaccgaaaataatcaaatactcgctgatactagcatgcaagataatcatttgacccatggcaccaccagcattgttgaacacccattcttcatcaacccattggttgatatagtcatcaccgtaatgtttggccaatgcatctcttaaatcttttagcatcaccttaacatcgaatgtttcggattcagcgtcatatttgctgataacagaattggatatctcgttcaatgtctttgcatcaaaaatgtagttggttggcaaccaggtatatagtaaactgttcaacagatagtacgctgtacctagtaatagtgcaattttcaaaagcttcatggcgaattactagtttcggaacacaagacaatttactccaaaaagataatttctctccgttatatttcactttctcaacctttggattagtagctcatcgccaaattcactttcgcttatcataccttatatatatatatatatatatggatgttttccataatttttgtcgtttatgctcatcggaaatccattcgagactgaatttttcacacagtactcgtttatattgaaaactcagaagaagctgaagaaaggtacgaaattcaagaaacttaccgaaagcttagtcttggagtaacaagctatatgatttacattattaaagcttgttttactaatacatatgaccattattaatgtgactatatatatgtgtatctatatagcctgtatttacgagatggggacagagagatgtagaaaagagtgaattgtgagtattatatgatacaggtggatctcattgctggttcaagcacctgtgctgaacatttgtagtagtgacttagctgctttcactgataccggtgtgtatccggatgagatcgcggatgttgatgcgtatggttttgccgggtaccttttctccggtgtgatacattggatgtgttgttgcgagcacactgccaagtttgaagtcccattgttattattattagttcttgaagtagcttctatggccggattcaatccagccaactttctggatttcctgtcattttcgggtttccttatcttgttagctgactgtttcttgcgacttactatttctgagaacttcaggtgcacttgtttggttctgtacttatagtacgctagctgaacccttgatctaagtctaagtatattttcatcagtcagttttgagttcttttctgttaattcgttgtttatcctttctttaacgtcatgtagagcttgaggtggtgtgctgtagaactggctggatgaagtttgagtgtttaggactgatgctaatgaaatttctgaattgttgaacgattctgtcgatggactattagaaggagtgtttagctgtggtctcacagaacgtttcccctgatgaagtttgttctcttgactcaatacgttcagttttgagctagatatttgccccagtggtaatctaactgacattgtaattgaaaaacagcgaaaactaacagtaactttgtaaatgcctaaccgactactgttctatgatgtgttgtgaagctcctggttcttgtaatgaatagcaaatctttgagagagtaaaggtcttccttgtcaattatatatcacaatcctaacaaagtatttacaattgtcttctaaactgtgagtttaataaccaacggaaatcggaaaatcagttaacagctgtagtatatgtaaacaactgtattaggatctgcttatttagtttgttgaaatgtcaatcactgacttattcactctggaatatcactgtgcacagagctaaaaaagaaatgtgttcagcgtattacctttcaggccaataacgaaaacactaacaaagacggttctttgtttacaatttgcccaaaaaagtacaacatttcacgcgtcgcgttctcgaaaaaattccgaaaaatgatgggaaatggtgtacgctagactgcgattttcagcgggctcaaaacggaacgagggtgtccctgccttgcagctcagttaggccttgctgatgttatcttcgactggcaagggtactttttcttaagaactttgtaaatccactctgtgtaagaattggacttcgctgtttgaaaagaaaaattcagaaatacacagaatataggactataattgttactagctttctatagttttgatgttcctttacaaggggaactgaatttggtttatccattcaggaagatcagataagatcctttcttcgatggtatcaccttttccgccggcaattttcagaatatattcgtttagttcagcactgcctaagatatctacgtgttcggcactcttggcgcccccacggatatcgaatctatcaggttgatgtctcatttccacaattttgacttcaataccagcagggttgtaagcagaaacgccttgcttccatttgtggcacattgcatgtgtcataagtgggactgttccgtcaccatctgcaaagaacactggttgtggtgagtcgtaagcgatagtcatgttcaagtaactggattcagaatccttcttgtatgtataagcacgttctgttgggttgttaattccgtaaagacagtatattttcatgtttggggcatttggtaagggaacatccaatggattactccaatatgaatggtataattcattgttcttcatttcttgctcacttttcgcgtacccgaaagaatactgatcagtgatacgtttttgtaaccagcttggtgaggtgtctctaacgtattgaacggcgctgctcatggtgaaatttgtccatgttgaattctctttagcaaggaagttcccatcgacatcagcaaatctaataaagttaccatatgtatcagtgttattgttagcagttgcattatcctctaccgagaaatcgagatcaccccaaatcaattcaccacctttaggtaacatcgatggaattcctccccaagtttgtatcatttctaatctttcacgcctggagaagaatttctccaaaccgtacatagctagggtgtttaattgaatagtatccttcatctcgccactaatcaacgctggtacacattttggtgcaccaagcagtgttcctgcaatatcaacgaacgcggcgatgtgtttatccacccatccctcaccgccgttaccgtacccttcaccagatgcttctatccattttagaaaatagaacactacttgtgatcccatcgaatggccaaccaacacagatttctctccagtttgttccaattgcaactcgatttgcatctttagtttggtgaaataacgatcacggacttctagatcaagatatgatagtctccaatcatacgcggctgttaccatcttattgctctcataaccaattgcgcctaagttttgaagcactttattccataaccaataacctgccatgaaaaaatcggccgcctcaaacccttgagctgcacgtaatttgtaatttggtggatcaagaccggtctcgggatccaacttgatgtgttttaaccaacagcttttctccaagaccattgttttcaacatataaaatgaaccccaaagccttttccggaaataaggctcactatcacattcctcatccttatacagcccccaggattcaatgccagttgagatgacaccgggaactattaccaacggatgcttatccgtcaagttgagatcttttctcaactgttttccaacggcaaacgattcagtcaagtccgcttgtgtgttgtcaaattggaaatcgtcaatcaaactggaaacgctttgcggtaacaggcctttccaatcaccaacgtaattttggacggactccaacacgtaaaagttttcaaatatatcattcctatacttgtcggtagacgagccaaaccaaagtgctagcagtaaacccagcattgcaccaaagatgaagattagccgtcttgaatccttccaagatctttctgtttcggagtcatcggcaccatgcttaacggaattgcgtcttttcaattctcctctcactcctgagctaacgtcagtaatcgatgatctcctggatctgctacccctactttcacttgatccgtcgtttcttgtgggtgagttctcctttcttaacgagtgcgaacgccttttagtcctaagcattgtcctttcattcacaagtttctcttgataaacaatattatagctcctgatcgtttcaacttcaaaaattcgaagattctaaacagttcacaatcgctgtcctaactttgcagatataccgtggctgtatggctgtatgaaagaaatatgttttccctcaaaccattgaaatgagttgcattgttttgccatatctattaaagttcgaaatgttccaagagatgaggtgatgcaggtatattggacaaacaggcaaacttgatataaaaaaaaaaacccacaaccgtggtatcgatgtgttgtcgatcgttgttctaggaggtgataccatcactcctcaaggcatagcatgcgcgcgtccaggaaatacaataatatcacgtgattatgtattcattctatttaactgtcgcatgactatcctcaatccagccttgtcttttccatgacaaatgcgatcatactaggcctagagtccgcctattcctcctctcatgaattctctgaaaaatctagtttcaacattcccatctgagtaatacctacatgtaatgtaagattaaactcgtgctctataatttctgttctatggctcgtatttcaattcttaaaatatcttgttacatgtaaaattgtaaaatcttaaccttttaaaagaatcccttaaactgaagaatcgaaagataaactgtaacacacagttaattcagctgctgatatcaccaaagaataactcacacatcgccgtattataatgttaagatcaacactttcaaattggagagaatatctaacgccaatatcgcatacttcgacttttgagacctctggccagttgacaccggaagaatttgtgaaggcaggagactatttggttcatatgtttccaacgtggaaatggaacggcaacgattttcagaacgtccatcataaagatttcttaccgaacgataagcaatttcttgttaccaagaaggtgccttgtaagttacgagccaataactatcttgaattggatgacacagaaacgaaagatgtcggagacggatgggctttacaggaagaacacagccaagatagtgaaaggaagagtacaaacaacgcggacgattctgagttaccggaagagctagaagagttgcatattgtcgacgatggggatgatgaggagtacgatgaccagttgtacgataacgagtttgcagatgatgacatcgtcgatattagaccttccaccttaagattctacgacttatatataacgtactcgacctcgtatcgtgtaccaaagatgtacttatgtgggtatgataatgatggaacgccgctatccccggatcagatgtttgaagatatagcagcagattatcgatccaagacagcaactatcgagccactcccctttttgaaggggaataatatttccgtatcaatacatccatgtaagcacgcaaacgtcatgaaggtacttatggagaaagtacggagttcaagaagccgtgcgaggaaagtcgatccccagacaaccgatgaggactgggaagatttacaatccgatgttgatgatggcttgcgggtcgatcaatacctagtcgtattcctaaagttcataaccagtgtaacaccaggcatagaacatgactacaccatggaaggctggtagaatgcatcagtatcgtttgcaaaactgttttaaataccaaattaatttataattcgtaatactgattgtagttttgtgatcatgtgatcaacttattttttgtcattatcaatcaataccactttaacgtttgaaagcaaatataggaagatgagatgagatgagatgagatgagatgaggtgggatgaggttagaagacatggctcggaatactgccgtgtctggtgcgttgaagattgttcatatctgaaataaatatatgatgaatttgtctgagcaacaaaagcaacagatcgtatgttattggattaatatgacaaaactggtatgtggaacttgaagttactaacatgaatatttaaaaccaggaattaaatcgacaaaaagctttggctcggctcaagcagagaggcataataaagacacctcaacagctaccagtgagtagtacgaagcaaaatgcactccctgcagaaaatgggaacaacaaaagatcctttgaaccaactccggaacagaagcaggctattcaggtaaatagggaaaaggcccaggaaagactaaagcaacgtcagcagaaccttagggacgcatctagtaatgaaaattcaactatcgaacagcagaaaaagccattagaaaagatacgacctagtgtccgcaggcaagattatattgagtacgatttttcaacaatgaagaactcctacggagggtttattaattcagaggagatgttagatggcggagattctaaaagagcgaagactttggaggattggcaagaggagcaaaaaaatcgtaggatgctttttgaggaagaaatgcccgcttttaacatgtcatcagctccgagatgtgacgaatgcggtatcaatatcgaaatggatccattaatgaagaaggtctttcatcttcagatttgcaaaacatgtgtgaaaaaccatcctgagaaatattccttattaacgaaaacagaatgcaaggaggattatttcgtaacggatcctgaactttctgatgtgtcattgttggatagattagacaaacctaatccccactcggggacattttctaggatgcaattatttgtaagatgtcaagtcgaacagtatgcattcaagaaatggggaggcgaagaagggttggacaaagagtggcagcgccgtgaagagggaaggagcgttaggaaagaaaaaaaatatcaacagaagttgaaagaaatgagacttaaaactagagcacaagagtatacaactcgactcaaggaattcaaacatgggaagaaacatgtgcatgatttcagtgacgcaagagacggaggagtcaacatggatggtgtaaaggttcaaatacggagatgtctagattgtggactcgaaattgaagagatcggattataaacgtacataaaaattcacaacttttgcctacataggtttatatacgtagtcgtgtcatacaaaatgttaggtgtaataattgtttcgaagaagaatctctaatatttcattacagctcaattagtaattgctcttgctgaacgggttcttctttaacttcttgctcagaaccatgtatagaaagttttctcagaggcaccgttgggaaatcgaacgacgtaatattctcttgttttagatgatcatccggataaggtctctcggacgcttgttctatttttggattttctatagtagtattttcatctggataaggtggctcgcttggttcctctagaatgagaccctcgagttgcgatgttgtcgatggtttttcgaatgaaaccggttgtggttcaggagcagctggttgctgattttgtaatgcacttccttgctgatatgtgttagtggtagcgccattggataaatgctgtgatactggagatgcatagttgagtattgttctctcattttgttgcggcgaatgaatttggggttgagctattatttgcgggctattgggctggtcatattgaggcatattctgatggtatccgtacgaattcctacctgattctggaatggcatattgttgtgaaaggctgatgttccttaattgcatttctagcatagagtcgtacatattcatgatatcggatatcttactgttcatttcatagacagtattgtatttggaaacggtatcactgagcgcatagtttagctttggtcttacacctagtaccttttgataaagttgctggagctgtgtatcttctaggacggcggttggtggctgcgttttcatcctctccactaaggaagcgaaaaggtgaatatcttcttcttcattactggataaatcgtagttgttttcaataggaggtgctactgacggcgaagaagtattatacatattcttcgcctgtgatttccttctcatctcctcttgctgatgttctctcaagctcgcctcgattgcagccttcaaatcaggatcctcttcatcaggatctttttttagtggttctaatttagcagtatccggaatgaaagtatctgcatctctaccattctccttcaaagaaagttcgatagctcttctgagatcctcatcgtcatcctcagaacgtgtaaatctcttcttgcctttcgatttcttccctttgcttgatttacgtttcaaatcgtagtcttcaaaacagttatcacaaacacgcactggctcgaaaatacccaagtcaggcaatggaatgaactttgatgaatgaagttggcagaagacaccaccacatgatctacaatgatgtttcctgttgagtaaagtaaattgtgtggagcaaatcatgcatgcatcggaatcaatccaatccgcaggagttttcgcatcaaacatagcatttaaattttctgtcggtttcaaattctccatgtcaatacctctggatactaatttctggtataccttaactacatagcttaattgcgagtcatttttgaaagccagatataattcccccactaatctactacaaaactgttctaattcgtagtctgtagattcagccaatattacttgctcgaggcagtccataaactctcgtgagcaaacctctttcaaaaagggaactccaccattcttcatgcaaacttctactagtcgccagacggagaactgcaaattttggttattcctggtctgtagcaccctctttttcaaacatctcatagcgtccttcggaggaagtcttctcgatcttatcatgtctgataactccaaagctgccgataggtctatctcaccgttaggtatcttttcattggtgcactgctctatcaaagcgtcaaattcggaaacactcatacttggaagggccatgatgtcttaaagtctaacgcaaatacagttgatagaagcgtagttccaactatgaaattaagctgcaaaaatgcttgttaatcactcggcaaatagtgaaagtagtttgttaaacagatggttctctagagtttgacatccttcattaactttcagcctccgatcttgcaaaagggatcctgatcgatcatattgaatttagataattaaatattcaatatcacgtgacgtctacacatatatatatatatataatgaagatgtcagtttagataggtattgatgtatacatgcacgaccgcgtagctttatgacacaaacgttactggaattgtacaaattacgtaggcatagttgaaaaaaagaggatctcatctacgcaaaggcgtcaaaatattgaagaccttgagtccttaatttcttatatccggaatatactacgacagaaggaatgcgatagaacccacaccgatcagcgccaacgacccccaccaatatttctctatgtttggcgcagtcttcttgacagcattagtcttgtgtctgttttcgatgctccttctcacgtgcgatatcaaatctctctttgcattgcttgtaggctgagcatcatcactggccgttggatttaatgttatggtgggaagcatcacaggtggcttatatgccaaaaataatggctgcaaaggggcaccatcgcttccatataattgtagagattgtttcccataatacgtgtctaattgcaccaagtaacttttgaatgattcggcctgataataacgtgagtaagtggatactccttcatcgtcacaaggttggctgagaagttgtcttccatcaacttcaatcggtgttagaactaattgtccgtcatccttaacttcataagtaccatgctgaaaaatcaagaccgctacaggacactttgggtcttgtggatttccagaaacttggtacattgcttcttcaaaatatccatcagcagtaaaagaatatgaaataccaggtaaagctggttcgatcaataattcctcgattggatcataaaatccaggccccgtgaacacttggtttgatttagaagaccatgttccttcaagatctgagttttggccacttacagcaacagcaaataacgaaagtggtattaatacacgcattcttttgtgaattttctcgaagtcctttgtattctgtcaataaaacacctgaatatatcacagcccttaatataactaagtacagctgattaaaactagactgtgagaatagtagtacctcgtgaggtgattgttcgccagtgatgtttgaccatttataatatctcgttgtttagagctactgatttctaaatatatagaatttctggtttcaatttcaatttttgtttccgtcaagatgttatgaaatggctgtgcggcagatatcagatcaaaggaaaactgcatagaagatgattgatgagaaaagtagagcaataggagagagatgacatctaaacctaacaaatgcctcggttccaatgttctctaaaaaactgaattacaattatatagggtaaaaatgtagtagaaaatctatgaattgaatgtaatgaattgaatgtaatgagtagatcaatctaattacattaaagaaagttaataatataactatatgattaatagtatagttcgggatgatatcaaccaaatgcctaagactttttgttctgtgatatttgattcacacgacggcatttcctagaggtaaagaaattagagaggatctattgctatttccgttcgaaatggatcctccaccgctggaaaagacggaagaactttgtccaacaaattttgctcgaggcgggacgatatatgagttgaccttatgacaatttgccattgatgccggatcgatgttttccttatcatcatatgatcgcttcatgcttgacgttgagtgtaaacttatgtgagagccattggccgagttcggcgtgagcttattatgggtaaacgaatgcagttgcggtgttaaaggtgaagaatgtgtgacgccataagtgctaaataggctattgtccgattgtgtagagattttcctcgaagaaggagaaaatgtctgttgtgaataaggtggggatgggaagttttgctgagcggaaggaacttggtaaattctggttggagttgaatattgtatttgtctctgctgtgacaagtattccatttgtctttggtagtccctaacctcaccgacaaattgtactataccgtcgaattctttataactttcccacaattgttctggacagtctaagatagcatcgatgtaaatatccacaatcgcatcactagtagatccagtaggaatcggtgtctgtagcaaaggccccaattcctggttagtgaacttgttgatgagttgaaacatcccatgcgtgacctcaaattgttcgaattttaacagttgatattgccagctggttaaatctatcaaaaattttttaatattgatcaattgaatcttctgtgttaaatcctcatcatcctcattttcttcttcattttgaagatcttcatcatcagtagagtccgattctttattaattgatgacgattcttctttatttctgtttaaccatttacgattatgttccaactgtctcctataaagttcgtattggatcgcacaattttcatcagcgtttaatatgtaatcatttatcattggctcataaatttcccatcccaaagtgttcaaaatatgtctttccatttgagtgaacatcgattcatcaaatgtctgagaatcattgcaaagatggatcaattctgataatcttgggattcttgccctgggattaggtccatagaatctgccacctgtaggaacactcacattgttaataatgtgattacatccaccccaagttttagcagctagccatagacaagttgcaaccaccaatttgacttgttctcttagcacaatacgttttgaacagtaacgatcgtaaagtctgacagcttgataaaagatcccattggttactctggttttcaatgcgagttcaaaaaagaaattgacaacaacgtgtctcgtcttagaaggacctagctctggttgttgatctatcaacttcgaatcaggttttagtctacaagattgagtgatacagttcagcgatatttcctgatgataatcctgaacagtttcgtaatgagcaagcaattcagcatttgacaattcaatcggataatatgtctgcttcgcagtgaccacaaggcccaatgaagattccctgctgccagagaattgattcatcgttatctgtttgatttacctttacctgagagcgcaaatataaatcaaccttctaaggaaaaaatgagcgaagtgcctgtacagattacctgaagtactagcgagagagaaaggatgaatgcgctgactggtacaagttgagctaaggaagagtagatgccaccgattgctgctgctagttcaggtagatagtagaagggtagaaagaaaattaacggacagtccaaacttcacaagaaatcactggttcattatatagaaaagaggtcactgttgtaagacaacacgagatagaacatcgcacataccttaaaccaaatcaggcaggcagctagacattttagggcgtactctcgaaaatttcagatcaaagaacatgaaaacgctctacacaaaaaataccagaacccaactggggagagatcctcgaatgctccaccaaattagtgaaccatcaacagctaatagtcagaagccctcgtattgacatactgccaaaaacacacagaaagaaaatacaatagtacctaatatttcgcagaatgcataccaccgccaactgttttgaccctcaaagcaaactatcctatttttttccaggccctcactgtactgactcccgcattcaatgctccaagataccttggtgcgattctaacaggcgtttccagaagcaccgtaggaagagaaacaggaataactcgtagttctaccaaagtcctgaaatctttcgctcaatctggaaaaaagcatcaagaaaaatcaaaacggtatatccaaactcatcgcgtcttcacaaaagtctagcgaaatgtgccaaattcatcaccaaaaagattcattctcaactagcatatcttctgttgacattgggaaaccacgaaatttttttttttttttggtgaaagtaagatttcgcagttttgaaggtaccttttagagcttggctgaaactggaaggaaaaaaatgtagtacgcttcaggcagagtatcaacatccatacggggaatttgtgctggctgattttcgcggagcctgggcaatatgcaggatgtactgtcttaattgcagagcgcaaaaagtaacagaaacttcttctcgaatgagacgttacaatggtgagagtggtgtactagttctttttttggcgtaatgctgccaaagtcaagtaatcaagatttccgagtcatgtgacatttaataaggttcatacaacggataggttcccattactatcttgggttgccagaacaatttcttgctttacattcttcgcttcttgttaaaactaaatttctgtcaaagggtacggtcagtttcgtggaagaacgggactgagaccaattcgtgagctgttttgatatataaacattctgtttctggatccacccacttgtcttggatgttagttgcacccttactgtaaatgacggtgcggaccttgaaagggcatttcgcattattgaacatcaggtaaattaaagacttatcttcggctatgttcgtcatgacaatgccatatactgggtaaaaaacctcttccgtttcagcagacatataagagcgaacaatatggtatttatgataccctatgggtaaaacaactgtggtcaataggtcaacctggcctgattggttgaactcataggtattacagaatcggcatacagttttcaattggttgtcgtaattaaccgctatgagttggaaacctcgatcctttaatacatgtactttactattttcagaatcaatcgtgatgtagcccaaatcttcacgtttgtctatgttgtaaatgttcagagatgcccttactttgtcgtaaaccaggagtgtggacagtgaccaaatggcataaaatgaatctatttggtacccaacatctaccactaaatcttgctccaagttgagattctgcttttcgatagtatatatcttgatatcctgtccgtgattaacaagtataatcagtcttgtctcgtaattctcccataataacgacttcatcgagttgacttcatactgcaacttcaactcatcgttttcataaatgtataatcgcgaagcagtagcagcgacatcgtatcttttctcaccagcagcttctaatgacatcaaactggggatctgggtaatttttgcgatgaaaatcccgatcagtccactattccctgaccatcctttatccttacctgtttcgctattgtttgtatatgtgcttttagtttttcttttgacatatctaacatcaacaaaaacatctaagaaaacctttagaacaggatgatactccaagtagaaaaatattcgggtacgttttgaatgtcacaaaagcagaatacttgattgttcgatcatagccactagttgaccaactgtaacataactggaccttatacggtcgatagcaggttattaatccattcatcttttgcggaaatatagttctacattgacaaggccaaaacaaaagtatagttatgggttctgatgatacgggaggtctattcaaatggacaattgatgcgctattcaacagagacacatctccatctacaatgtatgataaacaactgcagcaagactcattcgatgaggaaatatactcaagacctagagcctcatctttctcggatccagatatttactcaaaatatgaattattacgagatgaggacgaacctgacttattgagacctgttagcatgaacgggttaccttacgagaagcaggatacaaacactttccacgcaagaagagcaagagagaggcgagttcaagaaacgccaaatattagacgagcaccgaatcccaacgatcccataatctcaaaattatttcaagtcgatgaagatgattcacagttaaacactaatgagatgaggtcgcaacgagaaaaattcaacactggacggttaccgggcaagtttccatctccaactaagcagtataatgctcgtatatccaacagggatgcatttactggagctgaaagaaaagcggcatcaacagctccagcaataccaccagtagctccatcagtgcaaaacttggattacacacctgaatatgtgaaactcatggataaattgagcttaaacaacaaggagctacgtgatttaaaggtagatgtcagggaaagacagaagcacggaatggaaaaggaaacagaattgaaaaagaagtacctacagatacgacaagaacttatacaggagctaaaacagtccaagatgatttatgataactattgcaagctatactataagtacaaaggggtgaaacgttccatccaactgccgacccaaacactagcctccaattcttcaatgctagataaaattgcgtccttggaaaaacaaatcgttgatttatcaatagaaaaagacaggttaaagaagaaatcagaagaacgtatcctatccgtagaactacaaaagaaggagttggaaaacaaatttgaagtggaaagaatgatatatgaaagacggataaaggatttggaagaaaaattgtatgttcacgaacacccaatacgacctgcaacagacactagtccagtgtcatcttcatcattcatgccgcatactcaagaaacttctgacagcactgcttcgccatataaagaatacaacaatacgatagacacacaatttctaagaaatctagtcaaataacaagagaagaagctcaaaattgtaacaataaaaaaagtaatagtaacggtaacgttctaattaatgttttgtccagaaaaatccccagataaaaccttatgtattattatactagtaagtttaacttggatctaagatattccgaaaccaaagaaactcgagaaaaaaagaagtgtaggccaaaaactacataatggctaggctatccttcgttgcaccagagtttccagtgctacctactgttttttcatattgtactgtatacagtcttatttaactttctacacacgagttagataatcctcaacagaagtgcatgagagatggaaagctttctcgcaaataaggacactctcataatagctaccataacgaggtactgttcgtgtatcacatcacggaaactttcctattattaccccacagctgaacgcgacagatctcttgtagtaattacctccggaccctcgtggataattccagcacactaaacgcagagaaagatgcctatatagcctagtaatcagtagctaccaagaacatgtccataaccaaaatccaaattgttagtcatagactcgacatcaactgttacatttcggccatttgtctgtcccactgagtttctaagtgaaaaacatcagtttctttttcagatttttccgggcttgaaaaattcgaaaaaatttctactttgtgtattgtgtatataagagaatcagcacatcgatgggatgagccgatggtgtgatggaacttagtgttgtgctgtggagtaggtatagatagtttcatattgtataattgtagtctttaaactggttctcatcagaaatatcaacttccatagacgataaaaacattttatctttggtattatcttaattgcaccaccagagtcattcacaaactaaaagaaatgtcacaaactccaacacctatgttccatgaacaagaagatgtcagaatcttgggttacgatccattggtttcaccagctctccttcaggcccaagttcctgcctctcaagagtgtctagaaactgcgcaaaagggtagaaaagagtcaattgacatcatcactggtaaagacgacagagttctggttgttgttggtccatgttccatccatgacttgaaagaagcgcaagactacgctaagggattaaaggctttgtctgacgaactaaaaggtgatttatgtattataatgagagcttacttggaaaagccaagaactactgttggttggaaaggtttgatcaacgatccagatgtggataacacttacaacattaacaagggtttgcaagtctctagacaattgtttgtgaatttgactagtttaggtttgccaattggttccgaaatgttggacaccatttctccacaatacttggccgatttgttgtccttcggtgccattggtgccagaaccactgaatcacaattgcatagagaactagcatccggtttgtctttcccagtaggtttcaagaacggtaccgatggtaccttgggtgttgcattggacgctgttcaagctgcctctcactctcaccatttcatgggtgtcaccaagcacggtgtcgctgctattaccaccaccaagggtaacgaacactgtttcgtcattctaagaggtggtaagcaaggtaccaactacgacagtgtttctgtcgcagaagccaagaaagctctacctccaaccggtgttctaatgattgattactctcacggtaattctaataaagacttcagaaaccaaccaaaggttaacgacgccgtttgcgaacaaatcgctaacggtgaagacaaaatcatcggtgtcatgattgaatcccacatcaacgaaggtaagcaatctattccagcggaaggtaaagctggtttgaaatacggtgtttctatcacagatggatgtataagtttggaaacaactgctgaagtactaagaaaattggctgcagcagttagagcaagaagagaactaaaaaagaagaacactgaataaacttcatatcaataatcataaaagaaaacatatgaatacctgagtacccatttgaaacacgtttttatttaaataatcttttcgttcaattgctgaatttaacgatttgtatataatagtctaattacaacacggaaagacatgaatagataaaaaaaatcatgggctcgttttaataaaactctagcaagaacattataagttaacagcagaatgggttggtggattgtcaatgactgatttcaacaactcattttaacttgaaccctgtcaatgactcactctctgattctcttctgaagtttcgaaaaggtttaatttttttttaaaataatagaaaatacagaactaacgaatctaatcttatgaaatacaagtgtatcgatgaggatatatcgtcagcaagagatttcaaaggataaacagcaaacgactggtagcgactacagtaaatcacaatgacagtcgtgcatattattgatgtggaatctggtaatttgcaatccttgcagaatgctatcaatcatttaggttacgagacaagattaatcaagtctgcttcagatccagagttacaaactgctgaaagaatcatcctgccaggtgtcggtaattttggccattttgtcgataacttaacttctcgtgggtttgagcaacctatcaaagattatattgcatccggaaggccgttgatgggtatttgtgttggcttgcaagcgcttttcgatggatcttctgaatctccttcaagcagagggttaggtttaatcccaggtactttgtccaaatttgatatcagtgaaggtaaaagtgttcccgaaattggatggaataccattattccacaggacgatctttcatttggtttagatccttataaaaggtactacttcgttcattcttttgctatgatcgtcgatgatgtacaacttgatgacttgcatagtaagggatggaaagttgctttgacaagatacggtaacgaaagatttgttgccgccattcacaaggataatgtgttttctacacaattccatccggagaaatctggtaaggccggtctagaaattatagataactttttgaaaggtattcacccagttacagagtacacagatgaacaaaaatctcttttagggaatgactatacaaactttggtttgacaagaagaataattgcttgtctcgatgtccgtacgaatgatcaaggtgatctagtggtaaccaaaggggaccaatacgatgtccgtgaaaaaacagaaggaggcaacgttagaaacttgggaaaacctgtagagctcgcacaacgttactatgaacaaggtgctgatgaagttactttcttaaatatcaccagtttcagaaactgtccattaaaggatactccaatgttggatgtgctaagacttgctgccaagactgtgtttgtaccactgacagtcggaggtggtatcaaagatgtcgtggatgttgacggcacaaaagtaccggctttagatgtggccggcatgtatttcagatctggtgctgataaggtttctattggtacagatgcagtgtttgctgcagaaaagtactatgctaacggagaaaagggtgatggaaaatctccaattgaaacgatttctaaagcttatggtgcacaagcggtggttatttctgtggaccctaaaagagtttatgttaacaataggaacgaaacccctaataaatgtttccaaactttatcgcctaatcctgaggggcaaaattggtgctggtatcaatgtacaatcaagggtggtagagaatccagagacctaggagcctgggaattggctcatgcatgtgaagcccttggtgctggtgagattctcctaaactgtattgataaagacggctcaaactcaggatacgatttggaattaatcgatcatattaaaagtgccgtttcaattcctgttattgcctcatcaggtgcagggaatccaggtcactttgaacaaggatttacaaagacaaaggctgatgcttgtttaggtgcaggtatgttccatagaggagaatacactgttaaccaggtcaaggattacctgatctctaaaggtttaaaagtcagaattgataacgagtaaccttatcgattaatatcgactcatttaggttgttacctagtgcgtaatctttttaattaattttgtaaatatatagatacacaaatactgtctaatgaaagtacagataacttttattaattttaatcatccatttcatcagctcttttttctgcttcttcgtcagataatttaacaccaccagaaatagaaaactgaccaccgcagccaatgaagacaatgctgtgatcttgagtggccgtgtttttgattcttgtaggtgtttcaatatcatctccagaaggacctaaaccaactgcataagtttcaccgaatccccaggaatacactataccatttttggcaatagcgagggagtgatgagagcctgcagcgatggccttaaatgaaggaacgtcttctaattttgttggaagaggaatagaacgggccttgccatgaacatctttataagtgtactcaggtagtttatcctttgaaataccgacttcaaacatatctaatctaccacaagaatataaatcaccagatttcgccaatattagagtgtgatgttctccagcagaaacagaatcgatttcaactccttctggcaaaatgacctcagtaggaacacttaccaaggacccatcttctaattctgtagatataccacattgcccgaattgattaagaccccacgagtacagtttaccgtccgtggaaagggcaaatgaatgattttcacccgatgaaatatactttatgttatccaacccaaatggtcttggatctaaagttctcaaacgagaacgttccaaaattcttctacctaattgttgctgttgaccattaccccaggcgtaaacaataccagtttcatccaagaacaatatatgatctttcccagcagccatttgaacaatcttggctttcttggagaagttagggattatccaaggggttttctggacggtaatctcatctctgtagaaacctaaaataccttcgttacaacggaaggtaccccaagcgtaaacgtcaccattttcaaatagagcagcagatagattgtctgtggcagcaatctgtacacatcttaattcgtccaatggtaaagagtctctaggaattttagttggagtggattcaatttcgttgaggtcaccatcttcatcatcatcactatcatttgcatccatatctttcaatttttctacagctccgctagtgtctctacccaaagcacctgagtcgttagtcccccacgaccagatgttattgtcagcgtctagcgctagggtgtgcattccacctgcagcaaaagacacaattttagcctcatcacggggcaaaaggggattgagtctaggtctcttaacttctttgtttttagctagaggacccaagcctagttcacacattgatccagttccccatacaaaaatgtcaagtggaacaacagatctatacaaatgtttataatcatcttgagaattgatgctaacaaacttatgattcaaagtagagtgtaaatgcttccttttaactggagtgttcgctacactagaagatcttttagacatgatttcttcagtaactggtggtcaattaaaagattaattggaagggcctagtctaatgttaattgtaactttgctaagattgcaaggaacgaaaaaaacggaaatgaacacttggtttttgatcaatcgataagtacaactcaagggagaagcttgagtgaacaagagaccagcaatgtgtcaccacgcatatgagatcacattacacttgatccattgttaattatatatacgtaaaacgaatctaagctgcagttgaaaaatctttccagattttaaagtcacgtgcaaaacaaacaacattctttgcctgtaatcattagaagaacatagctcttggctgtttacagtagcttgaatttgtgttcaacgctgtggcatatctgtttcaatcacgacgatcccgctgccaatgctccagagttatttaattgaacctttgacttctctaaacagagtatctctagcctttctttttctgtccgtgcattgactgaaaatttttgggatttgaataagtaacgatgagatgagaagcgatgagatgagatgagatgagatgagatgaggtaaatggcagataacaatcacaaaattactcattagtgtctgctttagtgctcagaatacgactagtgatacaagatttatttgttctacggagaaaatgggtaaagtaatgggtggcagcggtcgtaaacagagacacgatcctttattgaacgatcttgactctcaacatggtaagttgaaaagacaaggtaagaaaaagatcgatgctaaggatcaaaaaggccatgaagatgaagaatttgtcgatgcccagcaatctagaaaaattttgcaattagctagggaacagcaggaagaattagaggaagaggacgagcagtctctgcagacatccagccaaggaataaacagattctgtgtggccaactatgcggatgaagatgatgtagctgaggaagaggaagctcaaggtaataacatatctgactttgaaccggaagatgaagacgatttcgaaggatacgaggaggaagaagtggtagaaattgacgaagaagatgctgaaatgtttgaccaatatttcaagacttctgctgatttcaactctgccaatggatcatataaccttgccgataagattatggcttctattagagaaaaagagatggaactacagtataatgaagaagaagcaggtgatgcctctgcagtagcggaaccagctgcacctgtagatcgtacagaaggtgtcgccttaccacccaaggtgattcaagcataccttgccgttggtaccattatgcagacctggagacatggtaaactacccaaactattcaaagttttgccttctctaaataactggcaagatgttctctatgttactaatccagaggaatggtctccgcatgctatatacgaaggtactaaactttttgtttctaacttatcatctaaagaggcccaaaaattcgttatagctgtgttgttaccacgcttcagagaagaaattgaatttaacgaagatcacaacttaaattaccatgtctaccgtgcattaaagaaatcattgtataaaccggctgcctttttcaaagggttcttattcccacttgtggaatccggttgtaatgttagagaagctaccattgctgcaagtgtgttatccaaggtctctgtgccagctcttcattctgctgcagcattgtcctaccttttaagattacctttttccccagccaccaccgttttcatcaaaattctactcgagaagaagtatgctttgccttatcaaactgttgacgaatgtgtcttctacttcatgagattcagagaagtcactgatggaagtacaggccaagatgccgtcagagtcttacctgtggtatggcataaagctttcttagcgtttgctcaacgttataagaatgatattacccaagatcaaagagatttcctacttgaaactgttcgtcaaagaggtcacaaagaaattggacctgaaatcagaagagaattattagccggtgatagtagagaatttgtcagtgatgttggtaataaagctgatttaatgtttgatgttctgtagtcaatagtcctataacaatataagtgcctgtcaattttaaacaagtgtataatatgcaattatagataagacaatcaatagaatcaatctattcgataagtggaaacggtatcaattaatttcatcgaatattcatgagtctattttgtactttgaagcttttgagtgaagcagagcctttatctaaatcttggagattttagcggaagacactcataaatctggaaatacttttattacaagataggtgaccaatagaccaattataataaacgataaaagtcctaacttcattaaaaatccaattttttcattgtgatactttttcaatctggatccgagtgaagaaaggctcttagaagtaacatgcaatccgatttctgctgccttaagaacagtagagtcgtgttcgatagcattctggaaagcttccgcaccttgtcttaagcctgaaactagctgggacatgtcttcaaccagttccttctgaagatcatcctgaatttgcatttgtttgtcaaatgattcaccctccgtatcagcgctgtcccttcttttacccataagcctttggcggagctccttcaaagaatcgttgtcattaattgcttcaacattggatattatatcaacatcgtcctcatctcctataggcacgtcgggcgttgcatcgaaatcaacactatatcgccttttcttttgagattcctgatatgcatcatatttctgttgcaacttagaagctttggagaaactgatagagctaaccgattcctctagtctgctaaagtttttctggtatctatcaatagcatcagaagacggatcatccaagttatcctttatagccagttttctcacggtatttaagtttgtggccagttttgtagatataagataatggtaaaaagggtcttcgtcatcttgaaagagcgaaaggtccctgtaataatttttgcgtagttgatcacttaatgtgtctaaatctgtcgtcatattccgtcagttaatgtcctttaacgaggcgctatccctttttatttgtgattggaattgtactaagtattattttaaaggctatattacattttgttttatgtcactaaaatattatcccaaacctcaatcaaagaaataacagagctgtctgaatgaaagtcattcactctgaagcatgacccttgccaacccttacaaaagcgcatgtaagaaagagtggaccgagtgctacttaatgtatctaccgatggtaagtataacataaggctgaacttggttaactattgctaaatcttattgatatacaaattcatacgactctcataatatttcagaggaaactactgaaccaattaaatgggtaatatttccgcccacctactatcaaactacaaactgtaggaattcagttgttgttagcgaaaagggcgttaaatgggagtatcccagctctgggcatcttgagcttacttctacatgcgtggaataagtctgcgccatgataaccacaacgcgaaccataattgaacatgccgaaatgtgtttaagagcccttgtttgctgagctaggaaccaaaaagataaccacaaatgacaagaatacttatcaactggaccatgtactgaggtcaagtataaagtaaaccaactttaaccaagttttgtatccttttcttttggttcatcaaatttttcagtaaacaccgggtaatgcagtgacaagttgcatgctaaccataggtcttataaccggaagcagggcagctaaggaagatataaaggatatgcagttacatttccataatgaatggggataatagactgtgcaaacagtggatttatatatatataagagtttaggatgaatttagatagtacttacattaatcggaaaacatggaagcctttttcttactcttcttgttcttcttgttatgcttcttaccattttcgttggcgacggtttgcttatggaaagggttcgtaagtctgccttgaacaccgttcaaatggaagaaatttttgtcaagttcatcagctacgttgtacaaggctgcttgtttaccaccatggttgacagatttagcttgtactttatcaccatcaccaccaatatgagcagagaacgttaatcgacttaaatcgcgagcaagatccaaatcttgtatacctttgtgtttggcagcttctgcaagttgctcttgtctgttgataggtaatttactgaacgtgtataaatctttgttgaattccttacattcttctctggtatatggcgtatcatcgtccatgtgaggcggtggattaatgtacaggagtttaccgttcacataatctttgagaatgtaacgagaggcacgagattcatctgcggcaccaaaaccttgtgtcatataaccacgagctctggcataagcaacgagtaattcttgtgcagttggtacttcaccattcccaccctcttctacggatttggtctgaatatggataccgtaaatggcttccaaaaagtatttagggaccctttctgccactaatgtcgatggcccaatatagtcacgtaactgatcgatcggtagaacaccgttacacaccaattcacctttattgtatgcaaaattagggaaaactagacctggacagtcgcataacgttaccttatcagataacttgatagtttggaaatgtttggtcttaccaggggtagaagagacagaaactttcttggcacccaccaaggcatttatagtggaagacttaccaacgtttggataacccactagacctatttgtatgattggctcttgaccgggcaatggaggaagtagcggatcgtttggcgctttatctaagaacaattcttcaagttgatcgatcttcagtatgttaattttatccagaatttctttgttcacttcttccccatcaagttcttcaatttcttcctctgtagccagtatttcctcatcgtcctcttcttcaacgtattcatcccctagttcctcttgtctctctaatatttcattagccttggcagcagaaaagaatgtaaaagagatgcccctcgagagaaggtacttggcccaaataatacgttgctttcttgttaataaatccgctttgttgatcaaaagtaaattctgtttcctgtcatccacttctttcacatatttctctaaatctgtggatctgaataataatggatctctggcatccacgatttggactactagatcacatcgctcaacaactctccacaactgcctccaaacttcaatgtttctctcgaatggagtcaataacaaatcctcgttgtcttcttgcaaataggctaatttacgtctccattccaagaatgcttccttttctaacctttctaattcaaatctggtcatagattcattccacttaggccttcttgggacaatcaactctctagcatgtaatctctgcttctcgttgatcttacttttctgctcattggtcaaactaaatccctgggatgtggctgcatcggcaccgttatccattctgatgatcttgacattagaatgtctgtccgctgtgaaatccttgtctgctaactcagcagtactcaaaaattcatctaatgcagattcctgagtaacagatctcaattttacccaattagcttcgtgcttatcggtagtgaaacgttcttcaccatctggcaaatactgcacttcattttccttacgtcttgcagtttgaattgccttacctaacccaatagtgtttttattcttcctttgaataggctttggaccctttggaggtttccacttctttgttgtttcctttggtggcatgctgctagtccgtgttgcttgtagacctgccgttaactgctaagattgttgtgctgatgctttgcttatgatgagatgagctggttaacatattaaaattttccgctagtacgtaaagtgtaaaaaagaaattgtgtggtaaacctgaactagaacagatggatggctcaacaatctttacaaaagcacccgcatgatgaggatgcagagtacgactccaacataggtattgcataccaccttagaggagcgacaaaattagaagtcaagagtttctgcagaatggaagaaactgcagctgataaaagggttaccacgcgtcttcctccatgttgcttgtgtattttaagagagaaatttatcattgtgggtacctatctcttgcataaggactcaggcaatcgaactggctctattgaggtttatgataaagaattgaaccttctttctagcataaaaacctatggggcaattttagatttgaagctcaatccattcgatgatactttactcgcaacagctcattcaaccggtaatatgattctgtggacgatatctgtcgacgatgataattcatcaattgatatcaaactattgaacaaccttcaagtatttgatcccacatgtctaataacgtctctccagttttctccattgctggataatctcgtacttttaaccactactaatggggattttgctactgttgatatcatacatggtgaaatatgctttatagaggaggtggagccatcgtatttcgactcctcaacaataaattatattgaggtgccaaatgcagacatcaaagttataaatgttcagaatgaccatgaacaaatctttcatttcaaacattctttggagtgctggaccggcgagttcggctgtttggctcctttgaaagatgttgtattcactggtggtgacgactctgcaattgcagctcatgatttgaattcaggcaaaaagatctggtccaattcaaaaattcatcaagctggtgttacggcaattaaggctgctagggagacatttagaggcaacaagccaacaagtttaatcacaggctcttatgatgaccatatacgatcctttgatctaagaatgctctcagaaaccacaatatatccagggacagacgtccctgtggttaataaatgggaagacaatttacagggtggtgtttggagattctcggaggccccaacgaatgacggactgtcaaataacagacttatggtttgttgcatgtataatggtgcgaaggttgtcaacgtccaaaacgatcatttcgtgaccgagcagtttataaaagaagggcatgaatcaatgtgttacggtggtgattggagtaaagaaacagttgcaacttgttctttttatgacaagtccctacaactttggaaaagtccaaattaatacacatatagttttaaaaggaacgaaaaaagcagacggaattgagacataattgatgtgttctcacttcgctgtttcgatgagcttcagtatgtattcttttttaaatataggaccatttgtttcatcttattaacgcacgtgacttcaagtatcttcatcctgcaacaccaaaacacgaaagttttggaaaaactgggtaagtaatcctttgatctaaaatttaattacttcagttaatataaagaaaaagacttcaaagattggtattttgatgaagtagtaggagcttcataatttctgatatctgaagcagcaaatttgtttcactggttctcacgtcattaaagatggattcacctgagtatttggagaaattaaaaccctttcaagagggaattcccaacagcattgctgagaagaaagaaagatacttgctaccactgcgtgatttggcatcagggaagcgcaaatttgatgaacagggaacagtaaagagattcgaacatttgcttgggttatctactttattcagacatttcattgaaaggaaagctgccaaggatcctagatttagagaggtattggacactattgataatgtcaacggcaaagcaaatggtaagggaaagaaacatacagatgcccgcagacgtaagactgaaaaggaagaggatgctgaacttatgaaagatgaagaagaagaggaagaggagcttgctgatgtcgatttccaattcagagaaagtccagcttatgttaacggacagttaagaccataccaaatccaaggtttgaactggctagtagcgttgcacaaaaatcaactagctggtattctagcagatgaaatggggttgggtaaaacgttacaaaccattgcatttttgggttatctaagatatattgaaaagaagaatggccccttccttgtgatagctcctaaatcgactttaaacaactggctcagggaaattaatagatggactccagaggtaagcgccttcattcttcaaggtgataaagaggaaagatctaagctatgtcacgataagcttttagcatgcgatttcgatatctgtgttgcatcctatgagattatcattagagaaaaagcctcctttaaaaaaattgactgggagtatgttgttattgatgaagctcatagaattaagaatgaagaatccatgctatcccaggttcttagagaattttcctctcgtaacaggttacttatcactggtactccgctacaaaataatcttcatgagctttgggctttattgaatttcttattgcctgatatttttgctgactcggcaacctttgatgaatggttctctagcgaatcatctgaagaggataaagaaaaagtggtcaaacaattgcacactgtgctcagtccctttttgctacgtcgtatcaagaacgacgtcgaaggttcattactacctaaaaaggaattgaacgtctatgttggtatgtcttcaatgcaaaaaaagtggtataaacagattctcgaaaaagatatagatgcagttaatggttcaaacggtcaaaaggaatcaaaaacccgtttgttgaatattgtcatgcaattgagaaaatgttgcaatcatccatacttattcgatggtgcagaaccaggtcctccatacactactgacgagcatttagtatacaattcagccaaattgaaagtgttggataaattactaaaaaaattcaaggaacaaggcagtcgtgtcctaattttctctcagatgtctcgtgtgctcgatatcttggaggattactgctatttccgtgagtacgagtactgtagaatcgatggttctactgcacacgaagatagaatcaacgctattgatgactataatgcaccagattctaagaagttcatatttcttctaactactcgtgctggtgggttgggtatcaacttaactactgcagatattgttgttttatacgattctgactggaatcctcaagcagatttgcaagcaatggatcgtgcgcacagaattggccaaaaaaagcaagtgcgggtattcagatttgtcactgacaatagtgtggaagagaagattttggaaagagctacacagaaactaaaattggatcagttagtcatccaacaagggcgagtcactaacaagaagaaggagaataaaaatgactccaaagagggattactttctatgattcagcatggtgctgttgatgtcttcaagagcaatgacagtagtgccatgaccagtcaaactggaacaccacatccagatgatgggaaggacaaggatgaagatgtggatttggatgccttgctagcacaatctgaagataagaccaggagtttgaacgccaagtatgcaactttgggtttggatgaacttcaacgattcaaccaagattctgcatatgaatgggatggtcaaaattttaaaaagaaggttgaaaaggatatcattaacccactatttatcccacctacgaaacgtgaacgttcaacgaatgctaactattctgttgataattattacaaagacgtgttaaaccctggacgtaacaatcaatatacggttccaccaaagatgccaaaattacaacctctaaatagccaccaattattaagaccacaattaaaggctatttacgaaaaggaaagaatgtggattgcaaagaaaaacaattatgttcccaaccttgatgacgttgtaacaacttatggtgacgtgaaagatgaagcagaaaagaaagataaactagaacttctaaagctatcgattgccaatgcagaaccattgacagaagaggaaactaataataaaattgaatgggagaaagaaggcttccataactggaataagttggatttccgtaagttcattactgcatcaggtaaacatggtcgtaattctattcaagccattgctgctgaattcggtggtagcaagacagaagaagaagtgagggcttatgctaaagcattctgggccaatcttgaaagagtggaagactatgaaagatacgtgaagaatattgagacggaagaagaaagagtgagacgagtaaagatgaatcaagaagctctacgtagaaagatcagccaatgcgcaaacccactatttgaactcaagttgaagttcccaccatctacaaacaataagagaacgttttccgaagaggaagatagatttatcttgttgatgttattcaaatacggacttgatagagagaacgtatacgaaatgattagggatgaaatcaagcaccatcctttgttcgaacttgacttctttttccaaagtagaacgccaattgaattacagagaagaaccatcactttgctccaatgtctagagaaggaatttaataccggaattcagaaaacagatgaattaaatgatcgactaaagaaagaagatgaagaaggtgagaggttgcgggagaagttgaaagaggagaacaaagccagaaggcaagaggaggaagaacaagaagaagaagaagaagaaaaagaagaagaagttaatggcactgcaactcaaagaaaagacgaagcaactgaagttgacaccgaagtcaatggaaacagccttaatgaacctgaacagaaaaaggtaaagacagaataaatatcataaacccttctgaatagagagaatccattgtataatactgaaataatataaaatttgttgaaaacgaaaacagttccttagtttttatgcaatttttgattcattttatcactcttattattattattatcattattttattatcatagttattattattatcagttggttatatttactttgaacacagtaaattaattagatatagaatagaatccaacagttcaatgaaaagattttaacaacttccggaagaggatagtgcaatacattttataaatagagcaagaatggtagagtggagtctgtgttttaatcaaatttattcattcaacaatttttcaataggttcttctaacgaagatggcttagtcaaagaactgtacctttcaacaacggtacccttcttgtcaacaaggaatttttcaaagttccatttgatacccttgaaacccaacaatccggatttttcgttcttcaagaagtcgtagactgggtcagcttcagaaccgttcacatcaaccttcttcaagattgggaaagaaacaccgtagtttagttgacagaactgagaaatctcttcatcagtacctggctcttgatgtccaaactggttacatgggaaacccaacacaatgaaccctttatcctcgtacttcttgtacaaagcttctagttccttatattgaggagtgaacccgcacttggaagcaacgttgacaattaaaacaactttaccttctagctgagtgaatgggaatggttcgccctttttgtcctttggtgctaattcgtaaaacttagacatcttggtaattgctgctgttcttttaatatatgaaaatattttgaatattggatatagctatagcttattcaacagtatataccaaaatattaacaccaatatcaatcagaaacgattttaggtggacaaaagttatattatttctgtattgaaatatcggtcttgtttatatagaatcattttttttttccctgtttaattctctattacaaagaatattagaaagcagaagtgctaaggaacggaaccaacaatcaggaacagcaacggaacgacagatttatcggccggacgatgaagaactgtacattctggtaacggcgttataacagtactgtaggtatatcatataagattttatgatgacaccgggtatatctgcatcctataagatttatagattagtaaactgtcagtgtttattgctatgtgtcaaagcatgcggaaatgttcgtttctgatgcaatgtatttcatgtgattacaaagcaacggctggatgtgtgcaatttggggcttagaacttagaattgatcggtacatgataaactccaagcaggtgagaagacggctttaaaccaccaatgtggcgtaccttttagctataaggtttctatttgtcagtgtttagattgaatctcgaacccttgatgatatctggtcacgtggtcaataattacatacattttaacatcacattatgaagggatatatacataaatcaccttgccgcttgtaccacactcatacacctgaactcgttcgagtaagatgctttccataaccgaatcttaccatcatctccggtactacttaggattgtacctgtgagattccaagatacggaccatacctcgccctgatggtctgaatgttcgctgatcagctcgacgtgaaggttagccactgatccatctgcatcaatggcggagctgtcaatgggtgggccatcacgttctatgtttgcattgttatcgttttcttcgtttataatattcgtaccgttgttacgcgattcggttactttgaatattcttaatttcccatctttgcagcccgtagcgatcaattggtaccacctgcccactgatggtgcccacgcaatggatctgattaatccagtgtgacccttcaaatgtcctgctgggaccaattttccctgtttgtttctttggtagatagttgcctgatccatggcactgataactaatctttctgttgaaaatctggagggacaccaggacagacaaaaatccgattgtagatgtgatgcaggtggagtatttaagacggtaatctcgcttgtcagggtccatgacctaagatcggaagactctaacgcatcataaagacgtaacttaccatcattccccaatgcagctagccttagtcccaaatgcgatggagcaaattttacgctgaacaacggtcctgtcgcatcgttcaacgtacaaagtttttgccaacgctttccggataactcaagggcatctggatcctcctcccatagtttgatagtcttatcgtatgagacactcgcgatgatacgaccaaattctggtgcggcccaatcaagagacacaatactgctatcgtgagccttccaactttcgctcaattcccactcattcgtttccttgtctagcttgaacaccttgatatgttggtcgctggaacatgttgcgactcgacgaccgtaaaagtcataactaatatcgtgcactaggtctgagtgtcctgtcaaaaacggtttcatgatgataaaagattttatcggatttaccactagattggtcgatagaataacttcaaccttcaaagccgtgaagtgtagatatctctcaactcagctcaactctctttccctctatcatgcaacttttagctttcgttttcgaaaagttcgaagttcaatgtttaaaggattcatatatatcgaaaatcaaaacacaataatttaagaaagcgcttggcattttaaatgctaagctaaaaaagtgcttactgaagctttatatatagccagtaccagctcagggaatgaaccatgctttcttattttttgctactgtttgctattgcaataattgtatattttaaagatgtatctcctatcggatctgcagtagggttttctgtaattggctacgtggcagttgatgtattgatcccacaagtaggtgattccttcatcaagattggtttatttggcaaagatatgagtaaacctggtaggccagtgattccagaaacaattggatctgtatctgctacagtgtatttgtttatcatgttcttttcgattcctttcatgttttacaaatatttggtgataacctctggaggtggaaatagagatctggtttctcaagaatcgacggaggaacagctattcccacatagtaagttaagtgaatttttaagtgcacttttatgtcttgaatccacgatattactaggtgctgctgacgatttgtttgatcttcgctggagacataaattcttcctaccagcaattgctgcgattccattacttgtagtctactatgttgattttagcgttacccatgttttgatccctaagtttgtacaagagttaattggtacaagcaagacatccattgatttaggcgctttctattactgctatatggcttcggtcgccattttctgtccaaattcaattaatatattggctggtgtcaatggacttgaagttgggcagagcattgtcctaggcctaatatttatgattaatgatgtgttgtatttaactatgggtgtgaacggacatgctcgtgaatcacacctattctcacttttattgatcgtcccattcctcggagtctcactagcattgttcaaatggaaccgctggcctgcaaaagtatttgtcggtgatacttactgttacttcgctggtatggttttcgctgtagtcggtattcttggacacttctcgaagactacgttactattctttctaccacaaatcttcaatttcatctattcagctccacaaatattcggattggtgccttgcccaaggcatagactaccgaaatttaacgagagtgattggctaatgtacacatcacgagcagatcttataaaagaaaaaccgaagccagtaatgcaaccgatattgagacttttgcacaaattgcgattaatcgatttgaacatcgatcccaaaacaaatacaattttagattgcagtaatatgacgttaatcaatttaatgattgtgtggtttgggcctatgagggaagataagctatgttactctatactcgcgctgcaattcattattggaatatctgcgatatgtctaagacatttaattggatcactattattcgggaacgataatttatggaacatcgtttagtgttgttaaatatccaagaaagctgtatcgatagaaatgaagacagtttctccctacttatagatcagatagatgaaaggaaaagaccccatcatattatacctcattttttttatttgcgttggttttattctatagtacttaatatttatgaatattcaatcaagatgctgaaatagtacaaatgtctatttataagatcaaatgaagaggctacatgatgatgttacaaagataaatatatcttactgtattatagctgctggaaaaattctgtacgtcttttgactaaatgggatacccatgatttgacttcctcagtcttaatgctgcttactgcaccatagaattgagacaaatcttttgtaccactatgccttttctcatattcgaaacattgtaccagcatttcgaacttgtcaatatccttaacgtatcttgcttctagtgagctaatgttttcatatgctaaccagtcagacaaaatctcatcggctgcaactgagttgtaaggttttataatttcctcgcataaatacgtaatggtatcaagttctctttgatgcttttcctcctttgttactggatcaaacggtgttatatcaccgactagagattcagcgatgtcatgcactaatgctatgcgaacacattttttgacatcaacatttggatctttgatcaacatagtagtaacccccatacggtacatatgatctgcgatactctcacaagggataatgtcatggtcaatccaacctgttctcttctgtagcttcaattgttccacaatatgcaaaaatgctaacacatagttaggctgaggttcagacaacagttccttcacttcagctggaacatgatccctaggattccactccatagtcatctttgatgttggaagtggtcgtgatgaaaaaaatcgacacgaactatcaaataagttgcccttctgatgagttaatctaaatgttatcgatgattgtttactaaaatatgaaaatgtcctgtacatgtttttatagttaaacaatatgaataagtatgacacagaaacgatctgaggccaacaaaaccgaaaaacaagaaaaccgattcaaagtgtatatgcagaggcttcagttcatgagttgtcaaactataatcgaattggttattgtccctactgtccaaaatgtaataaaattgttcagtttcataccgataaaaccaagagatatatgtaatatacaaaataaaaaacgaagtaaactgatctatgcaggataatcaaccttccagctgagaaatgctgaatgacatgaaatgagttgaaaaaacaaccaaaaattgatattaaagtattaaattaggcttaatgatcaaaaaaggtttttataaatctactgacaatgaatggtgttttctgaggtaatagatccgatgaaggttgtgagtttcttgacaatgtcaaagaaatcgatgaagtaaaaataatgcagtaaatgatattgataatttcatcaatagatttaagcaatcaattcaacaacaccaccagcagccttgatcttttcttcggccaacttggagacgaatctagccttgacgatgactgggacatctgggattctacccttacccaaaaccttaccgtaaccggcagccaaggtgtcaatgactggagcagcagacttggaagcagacttcaagtattcttctctcttttcttctgggaccaaagtccacaacttgtccaagttcaagactggcttccagaaatgagcttgttgcttgtggaagtatctcataccgaccttaccgaagtaacctggatggtacttatccaagttggttctgtggtggtgcaaaccaccagccatacctctaccaccgggatgctttctgtgcttaccgacacgacctttaccggctgtttaaaatggaggttaaattacaagtgattttgtaatttatgtgtttgttagtaaacctgtggttctgtgaatgaaatgatagacttccaatccattcttatatacgatgataaagagagttgctgcttgagcataagtttttaaagacaactacagttcgagaagaaagggaaagaacctacaagatgttgaattcttctatgacatagttagcagaacacacgggctataaggtcaatattcagtgcctgaaagtgaaaacgatgaaaggtgatggatgagacaaaatactgatcgagacagcgtaaaatcaatttatcacatcggcttagatgtgaaaaccttttcttcggatgcatgtaaccatcaacatggtacttatcatcctttcattaatcactttcggaagtgtcctctgtatcaatatcaatacagaagacatccggagtaaaatatagaccttatgcaaatgcttgtgaaactatccatagaaaatcaacgtcttggttctttcattccttgtccttccatcactggaaggacgtggttcgaactatagcgtactgacaaaaattgccgtacagtcttttgtgtatgtcccacctagtacatttgctaactctttcatgttatgcctcttaaagcagttacaaaaagaactaacgaacttggcagtacaacatcttctttatcatcgcaaatagtttggataatagtatgttcgatccggaactacatacctgagacgtgacctctgtgctttctagtcttagtcaatctggttggcattgttgttagattagtgcttggtttctcaagatcatgaatgtaagacaggtacaattcataatcactactcacaaatataagttagaagcgttgttggtgattgttctttatatattcaaagcatctgtaagcttgaaaaagcggcgtctggtaattttcaaaaaattagtggtaaagtcagaaataaccagatatggtaaccatttttattttctttaaatgttaaaaaaagttctggatgtactgatgcaaaacagtcccaacttatgtatgtctacttttaagggaacttaatgctcaaaacattgaaacacaaggaatatacatcagtttgctgcagatcattgttgctaagaaatactttcgagatatacttataccagtcctacctaccgtgatctgaaaacactttgagcaaaatcggagagatatttcttcgttggctggaaatactcaattcattatttggttggaccgcttttgataggaaatacgacgaggtggccagggcggtaagtttctgatgagtactaataatcgattacttccacatggtagggccgatgaattgaataacctagaaaatgcgagctcgaacaacaagggtgttactttcaccccacaccttcttctttctatgcttgttgcttgtttaggatctttgcaatatgggtatcatatgggagaactaaacgctcctgaagattacattacttgcaaagcagagttaaatccaggatacgctgattcttttctaggtaggcttggtttagctcaatgtatacccttgactgattctcagttcggattaatcacgtctgttttcagtgttggaggattgattgggtctctagtggctggaccattagcggattcttatggtaggaaaccgatcagttattggaactgttctgttggaattcttggagcagtatgtctattttccagcaacaactatcttgggatgctgttcggaagattactggctggtatttcatgcgggagtttgatcgttgtcactccattgtttatcaatgagatgtcaccggtacatttgaaagggtctttaggatctatgaatcaagtaagtataaactgtgggattctagtgacacagtctttagctatgttatgggctaacatgttgcaatggagatggattcttctgttcggtgggttaatctctttactaaattttggtctcttgttcagaataaacgagtcaccaagatggctcgtttctaaagggaacatgacagacgcagaggatgttttatcacaattacgtggcaactctcggcaggagtctagacaggagattgatggttggttgcaagggtcgcaaccggtgaggacgtttagtgatttagaagctcatacgaactctcagatgaatctggggtccaatttgaacttggagagaccgtcatctacgagatcttcgttgagagattcggaatcgataaccgttgttgaatactggaaggatccgaagtacaagtacccaagaagagtcatcacaactatattaatggctcaacaattttgtggtataaattcaattgtattttatggtgtcaaagtgataaagaaggcattccctgatactgcaatcatcattaattttgccatttcgattgtaaatgtattaatgactttcttttcatctccattggtggaccattggggtagaaaaccactattgatctcctcatcaacgctgatgtcaatatgttcctttatgatatgtttcggtatcgtaggtaatgcaccaatgatactagttatatttgtgattctatacatcaccgcatttgctggagggttaggtccgattccatttttgattatcagcgagctttcgcatccagagaccgtgggtgtggcacaaagttacggtaccacgatgaattggatcgctacgttcatggttgggtatggcttcccagcccttaatagtgttatggatggttacgtatttttattattctcagctgtcgccatatgtttctccttttacgtgtaccgctttgttcctgaaactaaaggcaaattagattacactgacatctggaagagccatgatccaagaatcgcttatactcagtgatggattaattcttggagtctaatattagtacttcatcctattgcacttttataagctattccaatattaacctaacatatattatagataaattaataaatacataaacagagcaaaaacaatggctcaagacaaggcaccgaggtatctcaacttcatttctttcaagatatcacgatatcacataccatatagtgcctagttgttctttttttttttcgtttaatatgttacattaatgctttaaaatgatagaaatacaacttgctatttccccatgtgaactgcaggggggggaggctaaactaaaggtctcgtgagccgttcaccatatgggcacaaaacgaccagataacgttatatatacatgaatgggagtccattttctaggagcatacctactagacggatagcaactagaaagagggaaaacaagtaggagacacttagtgtatggatcaatgatagaaatgaaggctgtttttttctttcttattagtattccttaaattcgtttaatcatggaaagggtacccgctgcgttcgaccaagtccgctcgccccgtctcaacaaggtactgttccacatctaacccgtatttagaccatttgacagtaggagcctcttgcgaaacaccagtgttcttctccagtgtgaaaatcgactgaagtagctgcctctgcgtcatcaaaacgtccatcaactcctgcatgttcctacactcgtctagctgaccgtataaaagagtgagctgcttcaaaagatgttgtttcagcgttagtgtgttgttcaaatgagtctgatactgttgcaaaacattgtaatccatactttcttccataccctggctttggaattgcacggcacgggaacatctctcgttttcactagtattactaatattgttattgttattattgctattcatactactggccatgattataactttgaatatggtagaataacaacggtgtatgcgtatatatcaatatcgataccaattccaattagtaagacttttttcaaagttaggctaaaaagagagaaaggaaactaaacaatctgtccagttccttcttccttagtatagtgtatagaaccagctaaatcacactctaacttcttatccagtgccagtcttacaatcctgtagtgttgcaccgatgcggttttgttcagatcagatgttgacagttgatatcgtgctgaaattaccgaatatcaaaatttcaatgttattatagcagtaagtagggaaaaaaaaaaattgaaaatgtttactatcgccaccttgaccgtttttggctgtatctcctatttactgagaaataacgaccgaaataacgaccgaaacgatgagggagatagaacgagtgacaggagacgaagaaacagtgggtgagtagaagagaacgtcaaatgtaatagatatagttaaaactctggggcgctctttagtcacgtgactgaaatttctctttcttcactcaattactactacccgtcagtgtaggatagtcagagtacatagcaagcatcaatgatttggagacagcaattgtcatcaggtgctctatgcaaagcggcttatataccaaatacctcaccacatcatagcatttctcgcatctctggctgcggcatcatagcccttctgcttttctttgttacgtcaactcttaatatacacacattctctatacttgataaaatgaaatatcaaacctttaaataaagatcagccttttaatatgataaaggttatataaaggaaacagacaagaccaaagaattttcacaatgcagaacttcaattcccaagctgccatggatagagagttttccccatcgatagtggggagtgccccgcatacacccattagaatgaacagtatagaagaagaagaagatgctatctcaccaccgtttctggcacagcaggattctgctattactggcacaacggtgaattcgcccatgcacgttacaaaaccattggttttcagcacagagacaccaccagggagaaggccgaattcgttttatagcgttcaaggcggaaacgattcttcaagttcgttagttgcaactaagggcttcactttcggtggtggaagcgataactctacaaatgatactcaactgattaatggtccaacatcagattaccatacacatagtaaaaaaccttccttcaaatacgttcctgccccaaagttacctccaatgtcaagaaatagatcaccagtaaggcataacagatccccatcaccagaaaggaaaagtaagaggaattcactgttgttcgaggctcctttcaatttcagctcctccgcattacaaccgcctccgctatctggctcttccaataactcgggacccagtagtggtggtactaatgggggtagtcgaagcgccatgtttcgtaagggccacagatataaacactcttctgtttccatgaacttcttccaagaacctgaggttaaggaaccgttaaatattataaagtcattaccagtaccggatttcaaagatctcagaaataacttgacgtggccattgacacatatccaaatttcaatctgcatcgttgaacttctgatatcgatattcattttcaacctagggcatcagaagggatggaacttactcggaacgttgtgtcatttcctcacgtatgatgttcttggtggtatctttgccattttaacagagcttttagctaagttcgaaatctggaaaacaggaacgataactctgccgttcggcttgaacagaattgatgtattgttgtcatttgcttttgcaatctcgatttgttttgctggtttagatttgatatttcatgtgctagaagaaatagccgttctattcgcagaaagttctactgctgatcatcacgaagaaattaaccagacgataccccactcacatcatacgcatctacaccaggagcaattaatatcatggtactctgtaattatactggcagctacaatttcgttcttgtcctattctttcatctttaagacaacacaatataagatcaaaaatcctttgattacgctgtcatatttgttctatatgtcattatatcccattttatcacactatcaccgtggatgggatatgttagccactgctgtaatatcatctttcattatgagctacggtatccaggtagcaaaatggacatcaacaattctattaatgggattttctactgcatcgataaacaatactttgttgatggacatagcctcttcagattcgaatcccaatgaggtatctgaaagagtacttctgaaaaggtcaaaatcaacgttaccaattgcagcggtacaaacagaaaacaatcaatcagcatctgttcaacttgatccttcgttcgtcaaatcaaaaatctatgatgctattttatcattaccgcttttcaaacgtacatgctctttaaagaacaatgaccttctttttgctaaagtgaacttccaaatgtttatagttttgattaagattgaaatgaaaaatggatcaaatgacgatgagctggatctcaggttaactatagaaaagttggtctcagattacgtaccaaatgccgagaccacaatagaaatagagaggatgtgaatgttatcaaagtatttaatgggaaatcttggcccagttgaaaagtaaatatatatgtgacttattcatatatctaagagggattagtcttttccaaccttgcatcgaataaacctaagctcaaactggtattattcaattcgccttccagtggctcttgatagttaaccaaatattggaaaggttcaatcttgaagatacaatcgaactgagatgacttcttattgaagacgaagtattttaaagctgagttcgttttggcctgtttatcacatatacctaaacgaattagacttggctcgtctttatcaaggaattcatcttcagtaccttcagaatctaagaaagacgaaatcgcgaatttcggcaattgattcaaaacgcttggcatttttattgagtgcagagcctgatcctttgtttcgtttaaaatataagactttagagaagttaggagatcataaagtagtagcttcaacttcaagtctttaccggtgttatggaacaaagtatagaaattgtcaaccatatagtgatcacggagctcaattgattcaaaacaatgtctcaatatgaacttctcatgaatgataacgatctttaatagctcgttcaagttttcgtcgtatttctttaatgtatcgttaggcatttttgcaaatgtagcaatagtatttttgaacagttccaaaacctctgaatccatccccaggcttgacatatttaccagatgcctgcttagtacaatttctgtatccatcattatatgcaagaagactaacgcagatttttctgtctccaaaactcttgctaaaaattgtctttcaataactgtcaaaagggtcgacacttgttttttgtctgagatattactgaatatttttggtaataatgagttgtaaccaattgcgccgacgatgctggagaaaaagtccgatagatcttcagcattagagttttttacattgaattcggtgagtatctggaacaaccaagtattggtgaagttcaaataccgatatagatcaatggtgttgtctattgcttcattttcgatattcattccatatatcaacatatctctaatgatagacatgtttttctcttctcttaaaatgtggctgacaacttgagcagatttttcactcaaatttgaatttggaccatattccactagcattctcactaaagtgtccctgaatgtaggtcgactgaaaagttgaagagtgatttgtttgaaattcctcttgacaaaggcattcttttcattttcgaaatttagaccataattaaagcttacttgtgacactaattcacataataaatcaaaatgtgatgtcttctgaattacctcaaaacttagtaattttaatgaaataagttttaataattcatgaacagtgaagtctcctcttttcacaaaaattgacaaaaacttattatactctgaggcgtgtgaggccttgcatagtaacaagagttttctacaattggattcatcttcgggattatgaagaacctttttaatattttgctggatcacactaggaaagttctgctcttcaaacttcgtattcttattaccggttatttccaggtataacgacaccgtttcgtttggcattttagtaaagtgatctttccggtgtctctctaactcgaaaacttcagcaatttgattctgcaacgacgagtccatttcaatcatgtttgcacaattcttaacgaaaaacttccaaaaactcttaaaatttatcaattcaaaagctgctttgtcttttatccgtagatccctcatataactgtgtaataatgtcttcataaataaaatatgatcattgataagtaaaagaaaagctttgtccaaataaagcaaaatgtcagtgaatacttctaagttttcaaggtcatcaattaattgatgataaacaatatactcagcccacccaaaaaagtgatgtaactctcctagattgatacaaaaaagttggaatgttttgatgatcttatgattattgaccttctgaagttccccttgattaaaacagatttgagataaataccattcggagcacataatccgtatgcttcctggatactcctcaagcctttcaaaatcaccactaagaagtttaggtttaaggctttcaaagatcgacactaacttgtcaaaattgtacttctcataaaagtgaggagcgtactccataacattctttaacaccatgttatattgcgacttcataataggtgatatctttaaattgataaggagtttacagtggaaatttttattctcggattctggcaaatagagtacaccagaacttatcaaacgtctgatgtatgttgggactttaattattccataaccaataaagacattcaaaagttgatgcaacttcggaagccatacgattttctgcaattctaactttgataatttagaaaaatggaaaataagactccatataacatcctcaatgctgtattcttggaatgattcttgagaattgatttttaaaactaatattttcgcaactaaatgacaactgtcatatcgatgcttacgtgaaggattgattgcccatagaataatttcaatgacctgttccattttcgtaattttttggtcaataaataagctccactctgagcctgaaaggccactatctaatacaccgagtaattctgggctcacattcttgagattcaaaatatttcctgagaaaacattgtctaaggtaagttcagtgctgaaaggagaggtttctcgagaaggttccacatcaagggatcccaaccgtaacgattcattcctatatgatatcaatttcaatttcttttttaactttggggtctcttcatcagagacattctgaagtaatatttgatacaagtaattcttatagatgttccaattttgctttggcatgatgaacgcttctaaggattgagtatggaaaatatgggaaataaactgccgcaaccgtaataaaacagactctttgagttttgaatttctctggacatcatttatgatatacttcgagtcattaatcatacacttggactcagatatgatgtggtactttcgtaatagaatttctgaaagctttattatcaaaaacgatgattctatttctgtatcttcttctgttgtcccaagaattccactccagaagatagaaaggatatgcaatgtcataggatagaattcgaagctctctattttacttaaaaaatctaccagccattgatgcaaagtagatctgtttaatagttccatttcataacagttacctagaatcttcaaataatgagcgatgcgtagcttccaatatttcaactgccccggatcattgtaatatttactgacttcaaaaaccaatttctcaaggataaggaccatattatcggtccagtctttgtacaaagtactaagaagctcttcatgggtggtttctcctttggcttttgagatcattcctttccattcaatagcatagcaacttttgattagccatatgacacgatatattggaacgaattgtgtgtagcattgttccaaaatgtgccttttcctaaatccatgaggaacagatttagttaatttccgcaatgatgtgttcgatgagcttaattcctgaagccacagattcctcttttgatctgtaagcgtgactctgttaggcaaatgaaaatcttgaccggaccatttagtgaaccttgtactgtcttctatgtccagtgtacttatcctattaatttcttgttctcgtatctcaataatcttggataattcatctcctaacaatgaggaaactttgggaagtgatccttgtaaagctgaacgagcagaaatggtttcaaagtttaccctagaagcagtatagtagccttttgccacgaactctttaagtatcttatcctcctctttggtgtgaatccacggatcaaaatcaggatagatttgtgggttggagtcggtgagcggatgtaattcctccggaggagttagtaaatattttgacggtgacatcagaagtatctagcggttattctctgactacttatatgtgttaacaagcactagttaagacagtttaacctgcctaaggtactttgaaggtttatagtgtttcagtgattctgaacgatcaatcacatatcaatttaaggtaaagaaagttctaaagtggaggaaaaacactgctcgaacaataaataacatgtcacatgatcaactcatcagaagaggcaaaatagatagtaagtataagatcattagtgccttctcaaatatcacttagacgagccccaagaatggggtacagttactatgatctttttacttatttagtgataatatgctatttactgtctgcttctttgctggtttggagttgtttgatacaacccttgtacgtatccttcaaagtgtcttcaatagagaataattcagacaacttttcttcgtcaaggtaagcagatggttgataaccatcaatgtcacgactgaggtcagtgtcaatatgttgtgaccagaatttctgttcacccttaccaactagaaggttaattgctataccctcagtattagcccttgcagttctaccacaacgatgaacatattgttgagaggagatcggtagatcatagtttatcacatgagtaatttcatttatatcgatacctctagccattatgtccgttgaaattaaaactgatttcttttgttctgaggatgcaaattcctgtattagttttctgctactacccttcgagatgttcgaatgaattgatgaaaggaacatattatactcatcttcaattattcctgatcctaacatggcatgtaataagctttctaatctgatcgaagcttcgttactcttcacaaacactaatattttagcgtttctcgaagcactgctcttgatgtcgtgtattattcttagtaagagtagtggcttgaacagactcttagcagtaggaatattgacattgagttcttgcaatttcttaggtattgaatataatttaacagaatctgtgaggaagatcttggggttgtggagatacaaattgtacaacttttctgcattcgtagtcaaagtagcagaaaagaccattttgattacgtttcctggacgtttatcctgcttatcgtttgtcaaatggtggaaaagcacttggttccaattttggaatgactgatttaatagtcggtctgcttcatcaaggactaagaacttcaaagtttttaggtcaaatgattccatctgcaagtgatcgaccagtctgcccggagtgatgattagaatgtctggagagttatacaaaaatttgttgtgttcttctttcaaggagttctcgagtttcgacattgatacattgagactggtcccttgacttagtttagagagacaatcgtagacttgatgaattaaaattttagtaggaaccaaaattattgccctaactttattcactgttctagatctcaaaatttgaaccaaagggacagaatatgctaaggtcttaccggaaccagttgatgcgtttactaatatatcaccaactcgtcttgtgaaaagttttctgtttgctttaaaagatgagtttagaagcgggagcactttatcgaatagaatggtctgaatagggaacgtttcagatgagaaattggaggtaatatttttaagcagacgtgcatctaattcaccttcgtagctatcgaattgtttaaccattttactatcgtaatgaattttggttgctgcatcccacgcagtggatttatatgtagacggatctagaagcttcaaggcttcattggtcactttggccggttgaggaattggggtaagactgtgaacatctttcatggatacgtcctcatcgtgtacatcgttgtcactactgaccttgtctgaagcgctcaacgcaccttgcagggaaagagtctgttgaaatctatttaatacggaactgtgctttgcatcaactgattgctgagaagtttctgtaggcgcaacagatgcaaccttgttttcatcttgctcactaattgtatcggaatcatcctcactgctggaagcatcatcctcactgctggaagcatcgtcctcaccagagccttcatcatcagtttccgcatctcttttcctcttttggggcacagtgggttcttttatttgtgtgacttcagctgttagtacattttcagtcaccttagtaggatcaaaccttgcagcaaacatgttattgactggatgctatcgttatgctgtcgctatgctgttactgaccttctaaattcctgaagctcatcgcatcatattacatctcatcgccattcgtctattattttatttcagaacggaattcataaaaaatttcaatctgtaaaacttgaaataacgacaagatataatagagttaagtcactaccatgatatcagtcagccaaaggttccagcagttagacaaatatctcgcgtctacgataacactcataacgtcataaaatgttcccgtcattgagattactatcacgttctgtatggaaaggtccaaatatagtcccattaccaataaaagaagcattggccaaaggtacgcccattagaacaaatgccagatctgccaccatattacctcaatttgtcggactgaaattccaagtgcataatggtaaggagtatgtcgcgtttgaagtgacagaagatatggtaggaagtaagctaggagaattcgtaccaacaagaaagagattcagttatactcaaactaagaacaaatgatttgacatttatgaaaagcacaaagttagtcagacagcagcatgtatataaaatcacacctggaagttcatgtaccaccgtgtactccatacgtaactgtatctattactaagaaatgatttattgaacaagtgctctcgattaattgggagttaatggtgtttctcattgttaaatagatgcaaatgttaatcataacgagtactatatataataattgaagtaaaatagaatatacactctttacttgaggtttcttttgaatttaatttatgattaagtttgtggacttttttcaaccactagatctttctccaccggatacaccacttagtagcttttcctctctaatcgcaccagtgcgatcaatgacaggccaatttccccagttcggtaaccgcagaattacgcaagtagcattatcagaatgtttagagctaatagccataacatattgtaaaacttcctgagcacagaagtgtggagaagcagttttcaaacctctattgttcactgtggaggtgatgagatcacagagttcttgatcgctcatcaattcagttactccgtctgtcactaaacataagaaacattcatcaccaccgaactgcaattttgatctttcagcatgtggtaacattttggttggtccaatgaggtacgaataaatgtccggctcgcacgttagaccatcacgttttccgatccgatcgccaaaggatcgtgtatttgcaaaattgttcaaaaatctagtatcaccgaaggagtcagtttggaattgacctccaagtcttctggactctctacttgatgaaggatgatgaactttagccaaagaatgagcaataccattcttgtcacaaagtataattttagtgtcaccgatttgagttacagccagttttagtaagccctgtggtgcaatgaaaaatgattcatcgtaacattcttcttcattataagaggttaaaaaaaggcttgaagcagtcgagccaccagtgaatattttcattgcttcttctggttctaaatccgaagaaaatccacatatttcatttaagtcataattgaggtaggatatgtacaaacgtaaacgttcgtattcactcaacaagcttgtcttgtcaataatgtttccccatttgtcaaagatcattcttgccccattttttggcgctacaccgtccgtgagtaggacttgctccactttagtgttacattttttgatatacctctcatagtactcctttctacctttgtatatcctcgaccagtacttcccccccactaagtcctgatatttttttaatacagcgtcaaactcttgtctgatggggaccatagctgttatatgatcgtgcaaacctgaagccagcatcttagagacacgatctcctccatgaccgtcaaatatagaaatattcaaaacgtttctctggggaggtaattctttccaaagtttcatcttagtagcgatcgatttttttgagtttaacaacgagctttcggctatagttgttggcaacttcagaatattcatagaataagaatcctcgttgtatagtctattaatccttgaagtcgcatgcccgatgaaaccaggatatttgttcaaatgaacccttaacatatgaggttttgtttctttcgaagcagcatggcttgccgctgtagtttgtagagtcgatctgccagctgtcttttgtagaagatcagctggccttaggtgaatgaatgactgggttttacccatctcgggttggctataatcacaatcgtgttcaacttaacacaaatggtaacacaagaattagcctcacaatatcttataaccgaataccccagacatataagaaaggttcaagaatgccaattgaaaacacttctctcgtgtgtggcggatgcatcaacgagccaaaaaaaagagccaaacccttgtatattcactagactttattataactagatttattttcctttaaagtgtacctactgtttttttttttttttttttttttttttttttctatacattccgcaatagtgcttcaacactaccctcttcatataggaaaccgtcaaaatctcactagtgtttcattaccacatgctagcgtgatatggaggtgtatataagccattgctatcgttaactaccgtatatggggctatcttgacgcattttgccaaatagtgacggaacggctgttactcggcagcagacaccaggagagaaaactatctgatcttatgcacgtgatacaaaaactaaaaaaatagacagtcgctttaacaccagcctacctaattactcgagcccggaagtcaaactaccccgcaatattctatcacgcataattcaagtagttggttcaaacaccctatttacctgcacccaccttacagcttgatcgtccataatccagtatagttgtttgatatttcaaaataggaaatacaacaactacctcagtaaggacttttctcgtaattcggaacccgcatagtgcagctggtgttcccaacgaaatgaacaaaatcttttaggttaaaagatctctcaaaccatgcacattttctgaacaatttcccggacatcagcaacaacacatattcgatcacatgacttccgaatattttcaactatgatttttcatcatcagaaactgacaaaaaattatgaagcaaatgttgaattgaaagagttatatcaatcggtcagtgaataaatgttggcgtaagttcaactctgagtttgacttacgtgcactggatcttaagaaacaatcctgtcaaagataccaatgttcaaacaggttttcggattgagcagtagtctgactagactatcgttgcgtaatgttcgttcaagcatagcatttgcaccaccactgcaacaacgttctttctcatatacttcaccaatacaagccacgttgaaccaaataaagagaggggtcaagcctcctggccgtaagaagatcactgaatccccagatttggaggtatgcccgattcgtaaaggagttgtgctaagagtgatggtattgaagccaaagaaacctaattctgctcagagaaaagcttgtagagtgagattaaccaatggtaacattgtttctgcatatatcccaggcgaaggccataacgcacaagagcacagtattgtatatgttcgtggaggccgttgccaagatttacctggtgtgaaatatcatgttgtccgtggtgccggtgatttggccggtgttgtcaacagaatcagctccagatcgaagtacggtgtgaagaaaccaacaaaggagtaagataccaacagtattatattctgaattatcaacataaaatatatacttatgtttataaactagaccttcatgtaaatatgcgaataatctatctactggttgctcaatctttatggccacgtgaccgaaattttgttcggatggtttttccatcatagaaaagtgctgaaaatttagttaacaacgatttcaacgaaaaggtgcccctattggaacaaacagaaagaaagattcatcatctgcaaggaattgggaaatttcgaagagactaaacctgctcagtgttgaggaaacttacaagttgatattgttccaagtcaattgaagaaaagctcatagacttgttcgaaaaaaaagcctgggtgaacacttgtgagccttctaatatcaatacataataatgttacaccttaaaccatacaacctattggtccaaaagacattaacagaagctttggaagcttacaacaatgggtctcctttaactttggacagaatcatctccgactttgattatacaacgttacacatcaccaacgatggcactgataagtcgaacctattagtttccatcagaaccaaggctacgcaatcttgtaatgagagtgggaacgatttacaagggttcttgcaggcaaaattcgatgaagtaccaggtttggctctatcatctgctaaaaaggaggccggttacgattttaccattactgttgatctatctcaaatcactgcgcaatctattgtgcaagcatctttgtttaagatccttgtaatgtcatatccattctatttagcgtttggccagagtaatgctctttctcaattgaatgaaatagaccaagtggaaaaatcaaaggaggccagggctatggttatcaaatacagagatgatgaaaacatatacatcaagccgtcctttgatcgtatcactgttatattcgaaactatattccaagatgaaactgacaaagttttcggtaaagttttcctacaagaattcgtagacgcaagaaagagaaatagatccatccaatctgcgcctcaagtgctattctcccatgaaccacctttggaaattcaagaagtagcccaacaacacgctcacgttgcaggtgctaagaagtctaccaggagattcatcacatttgtattgttcccacgtcactactcctccgatgaactaatgttcacatctgtgtcacagcttgccctattcaggaactatttccattaccatatcaagtgtgctaaggcatacatgcattcaagaatgagatatcgtgttgatacattcatcaaggtcttgaatagagcaaagctagacgaagaaactgaatccgattcacgtagaacaatcaccggtagaaaaatggtctactaagtagaaattggtttcaataatgtgtttaaagtataaaatagaatgctgccgatgtagcgatttatatcacgtgacaagtagatgatcctattcagatttttttccctccgtaatgccatgcaattgctgggcaataaacgctcgagccttgagtcagttctaacacaaccaaagaggaatggaaaaaaaaaaaaaaagaccgggtaaaacctacctgagtggaaagaaaaaaaaaaacaacgcaactccgagtcggaccattccgtcccagttttagagtgcttgagaagctcaagaagcttaattttcaattttcctcacccttgttgcagctgcgaagtaaggcacaaggtaaatggtacatggcctaaccagagtactaacgccggtcaagtttgggctggaattagcactgccctgccttgccccttcctttatctgtccaaaccccacttcacaattcagaacggaatgacagctgggcaagcctatactgccaatgttcgcaaacttgcattctggaaccaaaaccctacggccttacctgtttagccattccttacatggtaatgccatttgtgctttttttttttccttcattaattctacgcccacgttactgggtcttacccaaacggaatatattttatgatatcgtcggcaatttgggatgctattatccagtactccatcataatatacctcccactttgcgcacggctcataaaacctacgccaagttctggtagttaccttttttttttattttcgaacttcaaaatggctcaaaaacggcttcaaaattgaatcaggaaaaaaaaagcatccaaagttatggaaaatcccatacaatgaaacgacgacacaaggtgaaacaagaaccggtttgaatctgtcaaagcaaagccggagtgaagaaccagatagcaacgcaatgtttttagatgactgatcgtatattgtagaattcttttttcgttttccgggagtgcctaagtcctctttcatatatcgcatagccttccggttgcagccgcaaccaaatagcaattgactggggaagaaaacccaaccactgatacaacgattcagaatggaatttgtaaaagcatgacccagtaactaaactccagcagaacgagctatgtcattgatatatacattaaacaaggtagtgttttttttcttatctttatttagtatgtctgacctgacactgactcaagggagtttagcgctcattaccgagtcccttgttcctttaccaggcaccagctgctaacacgccatgagtactaacgaaaaagaaatctccaacatggctagatctccggtacagcaactcgtatgcgacagtttatgagctctttttttttttttactaccttccctctcgctcagctatacttaactaatttctttcctttccttccagagcttccaagcagttttttttttttgtttttgagtgattatattcttgttgatctaatgctctgcaactgaaaggagaatgccgaatcatttttccatcctttgggaagggcaacgagtgggtatgctgctgcgactttttctgtaacggtttggatttcaccgtttgtagtgtggcatacgcaaaagacctgtccatgtaggtattcatcattaatatggaacgcacggcttgtcctcgggtttctttagtttggtttttttttccctcgaacaagggtgcttgctcctctatgtgtgagtttgagtgtgggatggtcaagggagagagcgtcggctcttacgtgcaaatgtgaagcgctacttttggacccgctaaagcctttgattttggaaaaataaaaaaaaaggtaagatgctttagccatatatatatgtatatatattgagcattaaagtgatttacaggtatgtatggtgttgaaatacggaattggcgtatgttttttgtgtaagctctgctactgtacgtatttttttgttatcccataatcagacatcaaacggctgcgatatttttgttgtacttcctaagatatcagtactaatataatattctatggtttatattattcacttgggtaacgaattctaatagcatttacgattggaaaaataaagaaaaggaaaatatggacgttttatctcactcgagcgtcaacggttccgatcatgtacaaatgatccaactgccaccaatttcatcttttgattctttgatcagagctgcttcggtaacagataacaatagtataacgtcttcaaattcgaattttaacgcaggtacgccgagtccaggtgtgacgaatggccaagttcagttcactgtggggtctggtaccgtaaacattgcaccacgtacttctcgaacgtcggtaccgaatagcttgatggcttctacgttggtaagcgtgagtccccgtgccagtgcaagtgtaaatgcagcttatacgaatgccaacactcctagcactcatcacaacggtaattataatgctgaccacgcggaaagttttagtagcagtgtcagttttaatgataataacaataataatattcaacacaatcaacatcaccatcataatctgcagcagcaactgcagcagcatcaacgtcatccacagcaaatacaacgtcaagagtcaaacaaccactctgtccctgtagtcgtctcttccggtaaaacgtttacagattctttgatgtcctaccaattcggaagcacaggcagctccggatcaagccctaacggtcaacaataccgtccatcttcatatttccaatcatcattgtcgaatggtaacggttctcatacacaatccccctttgctggtaaccctgtttcgcaaccacatcatcagataatccccaaacttaattcaggtatttcaaatatgaattcattaatggatcaacaaacgtcacctactagcgataataataatagtaatgtgcatcaccagcagctacatacacactacggtcaaggccacggtagctcttgtaaccatacacactcacattcccaaggtagcttgcatcatatgatttctccgatatcaacaactaacaatcatgcgacaagcccaacaaattcaattgcaacggttttatcaccaactacatcgacaccctcgtctacggtgtcgagtacatcaaaactctcatcgttatccacatcaagtgatctaaatacacatcttatggataactcgaaatcggctaagatgaagatcgaaaataatgcaaacatggtttccaaaaaacaaccaagaaagaagaagcaatgtcctttatgtggtctctttttctctaatttatcaacacataagtcaacccacctgtcacccgagacacggcctttcaaatgtgaggtttgttctcgtggatttgccagatccaatgatttgataagacataaaaaattgcattggaaagatgacttaaaccaagaatctatggattttgttgagaagttaaagtgcttgcatgaattaaaaggaacctataaatgcccttttaactctaacttgattaacttagatctaaaattaaagggctctgacatgaaaaccgcagatttgccattcgagacttcaaattgccattcaactggggttttctcacgttgcgacactttcaaaaaccatttgaaagctttgcattttgaatacccaccaggaacaaagaaaaaagatagagcgaacgttgcaggccattgcaaacactgtggtcagaaatttgaaagtattgaaacgtggttaaaagatcatgttggcaaagaatgtggctataactacactggctgagaacggatatccagggtaatgtgctggcacaaaaacgatctatggagtgaggaacgaacaaacataactaaaacaatatgaaacgaattatacccgggaatatgtatacctctatttccttacccaaacatacgacacataaacgcacggattgtgaatacggtacttgtagcactacatgaaccgaactgtccatatatatgtatttatataaagttatatattaatgagaaacgagattttttaataattacttcaatttactgaggttggcactaaaataattagcgaatgaaagaaataaaactgtttatgaggcaagtgtctttcattcaattgaatgtcggaagagggtactagctttatgataacgttttagatgttatattcttttatgattagcaaatcaatccttaagttccatagtatccatcatgtaaacatttaacgcttaaaaacttttatatttatgatatatttatatataagaagagagaaggagaaaaaatagagacaatgtaaatgccttttcaattttgtgatcggaggtcacaattatgattatctgtctcttcgcatccgacgtctgatcagtaaaatattcttattatgtgcctgtgaatgttgtaactgtttttctttctctcttggttaatatgcgtaattcaaaatcatgagaaggttcaaaagacgatgagagttatagttcgtaaaataatgtagtaagttgttaacatattaatatatcatgtggtgatgataagtgtggactatggaaagtaggaaagaaggtgagaaagtataaatggaaataaataggagaattggtcatgaattgatggaaactaaagaaaccaagttaattgttagctagttcagttcttcttcttaccagttccgacaccaacgttgttcacgtttctgaacatgtaaacacccttggagtcagcatcgtcaacgtattggcaagttcttgcactcttccatagtgatacccacatattctcatcgttaaaacggtaatgttcacccataaccttcttgatagcttctgaagcaggtctagcgttgtagaatggaattctggaacagtagtggtgcagaacatgtgtttcgataatgtcgtggaagatatgagggccaatgaatccgaattgtctatcaatagtggcagctgcacctttagcgaaggaccattggtcagcctcgtaatgtggcatagaggcatctgtgtgttgcaagtacgtgatgaacactaaccaatggttaacccaaatgtatggaacaaaccagttaatgaaaacagaccagccgccaaatttatcataccatatcttcaacaccaacgattgtgtcagaatacccaaatctgatagcagaatgtaaatgtagtctttatcgtcgaacacaggagaacttggccagaaatggttccatttccattttggtacgtctggataaggctgaccagtgacattggttagcaaatagtagatccaaccacccaattgttgagtaagtaattctatcaaagttctaattggagagtcttcagagaattcatcgatgtcagcaagaataccacgagacttgacgaaatcttcttttgtctttggtacgaaaaccatatctctagtaatatggccggtagccttatgatgcttagagtgggtatatttccatgaaaagtatggcactaacaagtaagagtgcaaaacccaacccacaaaatcgttgacagcaccataatcagaaaaggcttgatgaccacattcgtgtgctaacacccatagaccagtaccgaaaagaccttgaacgtagccataaaatgcccaatacacaaaccttgcagcaacgtgtagatctttgacgtatggataagcaaagacattggcaaagtaaccgataccggccatgatagcgatatcacggaacacatagtataacgagacagctaactttctattatagcattctggaggaatggcacttaaaatgtccttgatggtataatccggcactttgaacacattaccatgtgtgtctatagcgactttgcaagactcggtagtagtttcagcatcggttacgtactgagactgagacattgttttgattggaaaatgtccacaagtaatctaaaagcgggcccagttaaaatcaggaatataaattcaataccaaaaggtacaccgggtgatacagtctagattaagctctgaatttatgcagcagaaccccttttcacagccgaaacagatatcaagagattagcctgatgatatgtcccttttaaatagaactagattgctcaaatctatcactatatatatgtaaatattctataactcaaaaactcaaaaagaccaaaattgggacaatcttaatatttaaaatttaaactgcctttggttttatatattggaaatgaaattacggtaaagatttgaattaatgtatttagacaatacgccgcagcagcgttaacgagaaaaaaaagtaagaaatatatatttcgaaaagtaacggagtgcactacattgatctccctgccagcgcgcgtcaagaaagggtccacattggaagttactgatgccgttgatatccaagggcctggacttaacagggcatgaggatggatttatcactccgttgctgataccaatcgtaacacaatcttgcttattcactatatactacaaataaatactaagaacgaatatccaattggacaaaaaagcacctataaacgattgtattggctacgcttaacggtttaatgtttcaattctttttttttacgaattgtactgtggtgaaatcagcgagggacactgattctttatgaaaccaaatccaaccaaaaggaaaatgcgtcaaaggctagtagggagagaaaaaaaaaaaaaacaaaacagacaccaatgtctgatatcttgccatcgattgacaattgagcttctacaataacactggatactcccggatctctcatcaagggtgagagaatgtacagttgatcgattgaaggtgtaacattgccaacaaaactctgtagcaaatcacgcgatcaacttacatatccaataggatacctcaaaaaacagtccgtaatctccttgatgacagagaagcttacacacgcttctctttagtgcaaagtgacaatgactaccccctttctgtttctctgtaactcatcgcatctcatctcatctcgtctcatctcatatagtatggggacctgttgtttttcttttttttttttgttgggaaaaacaagatcgaggatcggaaatttctttttctaaaaaaactaacgaatttcttttcgggttcaggtgaataggcacaattgatttggcaaatctggcgcagatgttaaatgttatccgggtaatgaagaacgtcacgtggtttgccacatttcattctttttgcacttgtttaccggtatagaaacagagtggatatcagaaacgtcgtagaaataaagaggaaacacatagtgaagggacgatggccgggtagtgtaattgccagttgaaaaaatcgtacttagctccagtcaaatgagggaaaggccttagattcaaccttcgacaggcagaatatggtaaagatgtccaaagaaaaaggttcaatatcatcacttatccaagtcaccagaatatacaggtaacttcccattatgtcagacaaagatggaaccgctagtgggcttaaggaaacgccagatttcataaagaaacctttgtctcatgacgaattttttgttaagcttgaaaaagctttcagaatgtccaaggtatcgcacaatcagctcaaagtaagcttgaaaagagacttgggcagtcatcacgttcaaaaacctaatgaattggatgttacttccaatcctactggtgatatctcaaagatgtcagaatccaaacgtttaaaacaaaacgctcaaccagatacaaaaccatacagacttatcgtgctagtgagcatgccatatgatgggaaacgaacgaaattcttcactttggtagattcaaagactcttgataaattttggaaggattatgttaatgttgtaaaaacaagtatgtctggattaattaaaaagaagaagaagaagaagggtggtaagaaaaactgatgaaatattcccaacctattatcacccatgaatcataaatccgcaatcgtgtagcattataaagtacatgttatatatacatatatagatgtcaaactgcaaaccagtaatttggttttcattcgaactccacgacaattgttcccgatggataaattgtccgttcttccttgatcactgtggttggctccaaacgggttctgggcacaggtgaatatagttgaaagtcatactgatactcgtaatttggtttttcttgtgtaatatcattctcgctgctagtgtcagataataaacctgctctgtataatgcaacgtatgcgtaaatctcctcaattgttaatgaagcatcaaatcttctaataattctttcattttctagtctgatgcttactctgcaaccgtcacccgatggttctggcactagtacagattttctccaagccaaccatttctttttaagttggctttcctcgattaccctatccctttcctggtccctttctagcgattcttggtatctcgaatcttgttgttctcttaataaccgttgcatttcctggtactgtctttgccttctaatctcaactaatactgaataatatgaggctaatttggcctcaaaatgagagaaatcataatcaaatagttggccctccactctggcaagcaatttcattttattattccgttggggtccaagggcacctaaaaatggaaactgtctaatctttaaagaattagcagtctgtagcccttgtggtgttgtaacatcgcaaaaccatacaacgcaattatatttggtgacacattctacaaactcgttggaagttaaaatctttcttacgtactcgaatggatcgtatagtatcggattgaagaaagatattattgcaaatttaccatcgctggaacaccgacgtaagatatcagtgtaaccacccttaatcatatttttgctcaacattccattctctacattgtacaacgtatcgaatgtataaccactctgttcgttggtatcggctgatgaagaaaggacatctataacatttacgaattggttacccaaatcatcgctgaaatgattgtcttttcttgtgtagaaatgaaagatcttgcctattggtttgaaaacttccaccgaagttaacaggatattgagcaagtaatatagtaatgttagtggaatgtataagcacatttttaatattctaggaacgccagcattcagtattgtttcctgttcaggttgttctgtattatcattgtcttcagggaatgatcctgggagaggggtaaaactcactgcaggttggttctgctgagacggcctactgaaaatgttgaataccatgttcaacagttgcagattcgtttctatagaagagtacagcctctaatataggtgaagctttctcttcttctactgaagatttaccctatggataccattgacaacttttaaaggatgtctgatattgttttttaaatgtcaaatttaatggacagacaatgatagatcatcgtgagtggaaattcacaaagaaaagcgccacggctaaatagtacaactaaggcatttaatagttagagtataattcccgatgattgctactctcaattttattatattccgaaagttattttcttcacctatggagtcatgttaatttaggtatcataatgagtatatagttttatagtattacacatgccatcagagttaatcgtgaattcattacactttcattgacagattagacatggatggttctccgcgtctattaatgaaattgttaacgtcaaggatagccagtccgaatatgggatgaataggctcaacttccggttctggcacaagtggagttgcaacaaaatcgaagggtgaattgtttcggaccataaaagaatgttcgcaaattgataaaccagccaacacataattggtatgataaaagtccgcttgtgttcccggtttatctcttaggccagggctttcttccgattgacagcatttcaatatatattgttttagggcgtctttatctatgcatactccatacccgtatgcttctaagattgcagcagttccgccaacccaaaaactgtagcaaccatctgtaagtttattgcttcttccgtttaaacctttctcctctttagtttgacgagaactacaccatgacaataacgcatcgatattgaccttatctaaggcattcaacattgccaagctggctactgcacaaaaagtgtagccaccatgtgcttcatcatttgggcagcctccgaaaccaccctcgtaagattggcatcttgtcaagaattccgtcacattacttgttagtttagagtccacaatgcctagtagtgacgctatagataatgcagtgtatacgcctctcacatcttgttcgccgactgggcgtgcagtcatgaacgcgccgctaggtgttttaagagaaatgagccagtcgtatatagcctttttattgatttctctgttatcatcgagattgtgacatagagcgatggaatttatagcagcgtatgtggccgctagatgtggtagttgatgctttccgccgctgaagggaccacctgtaggtgatatataccatagcttgtccaaaatacgcttctgataatcgttcgtaagccaagtgggattcattgttttgaaggcattgccaatccagtacaacagccatggctgagaggcatcgagtgatttgaatcccgaaggtaatggattatttaaccaatattcaaggaacatcttatgagaatccttctgcaaatggttgaatttctctggagccttttcataaagctccagacattcatttattaactcttccctttccaccaaggtttcagtaatcagccctgtatttgaagttctaatttccatcacttcttcctcatctaccacttcttgctctattgtttctcgtttccttccaagcacattggttcgaagataactcatctttttgatagccctggtagcactatttatagccattggcctttgtccagatctttgctttcctgttctcgccctctttgatgcttctgaaactggcaatttactattacgaaacctcaatctttattcaaataacatttacggtagatatttataactgagaaatgagtttaatgcatcgataacctcaaaaactgagaataaggctaaatgactaattgactgatgcccagaggagcgcaagctatgctggaaaagcaagcagactctgtgtggaaccagctgtatgagatatgctggaacttctacgtgaagaacgtttgggatattaacacatttaaagcgatagtggacaaaatagagaaaagtgatgacaaacagctaatacggtttttgatttggtttaatgatgctcgtaaaagatctaatttcaatgacaagttccaatggatgacgtcttttttgtatggtaggcgttatccgccattgggcgatgatctagtggtcaaagaaccctggaatgatttgcaacaattagacagtattataaagtacgggaatgaaccaattgacttggtcaaaatgcagccagattttactacggaggaacgtattgtacagaataggcgggtcaacaactgttctttaatatgtagtttgaccaatgctagagaggaaaatcagataaagagttatagcgtccataacgttttcaacgtgattcttcatttcaatgggtcaaatcgactagtgtcagtattacgagattcaaattttccaaaatgctctaaagacggggctgccttgactctcttctcccataatatagaagatatgttgattgagcttgcatatttcgaaatcaagaataatcggaactacgcgtatgggggatccaatacagctactgatacttatttgctcacaggatggataccagagattctcaacctaggagacgtatcatttagtgaaatacgtaaatgttaccaattcaatgccatgcttgctttaggaacagattcagtgaagggaaaagaggtaacagaaaatcatgattttgttgtgacttctgtcaattggaagaaggaacaatttaccatcctaaatcctcacggtactgaaaaccccactgtgtatacttgggacgacctaataaaagaattcaaatggttatatgtaaattgggatccatattcaaagtacactcaacgtgtaaaactacatgatcgatatccagataaatttaatgcatatcctacctggactcaaaaacctttgatgtgcattgagaacaaatcaaacagcattcaaaattgtcatctttatctagaaagacacctactagatgattctattctcgaatccaacctgacaattggtgaaattccaaggtctgggtttacagctgtctcagcggaggggaataatagtggattctgtaatatgcaactgcggctaaacccccatgaaacacgtctaatcttttatcattcagacaaaaagtgcaatttgactttccatttactatctaattctggtttggtttcaatgtcaaaatgtaaatcagatatattaactgctgagtctagctggaatatcacaaataatcagtggactattggtacttctgaatatttcaaaagtcctgttttcaaactaaaaagtgatggtttcgatgatacttatctagattttgagctagtctcgcagttaccagcgaaggtgaattttcaaatatttgagtccgatgattatgccctacaacgtccgatctttaagaatgacacatactccccacaaattttttccaagcatggagtaaggttattaaaagggagagaatactttatagtatgctccatcgctcatcatattacctctccgttcatatttacgctgcgaaaccctgaaacaaagcagtcaaaatttgaactatctccatattcgttaggatttgggggattaagatataatgaggttttgcggtgcaaaacgagaatcacaatatcagtttcaaatttcacgcggttatttgttctgctgttcacgtcagcttcgaaaacaaatggaagactcacgttacgtttgtacgagaaagaaacagaggaaatcctctttgaacaaatagaaacaaggtatgatcttagtgttaaaccattcccgataccgaatattgaacttaagccagcatcgtacgtgttagaaatattctacaatgcagatgttgtgatctgtaatctcggaacttctcaccgagctatattcgaatcggatctataatttcaacaagtacgttgtggaggtttccacccacaagcatatccatcacattgcatcacgtgatttgtatttatgtttgctcaaaaggtaaacaaaaacgatttataagataaataatgaaatttgtaacaattaaggtcataacgatctttgtcaagccgtttaccgttgatactaatgcaaaagcgcggaaacaaagcaaataaataatggcattttggcgaaatagacatgaatcaccagccatttcacaagaaagaagccccagtcctgacaggttccaaaatagtgaagatataagggaagataataataattataatgaggatgaaaaattaggatggtttgcttcgttcatgggaatgttttcattaccttacgactggtacttatctatcaacgaagatatagctgtgattgactgggatagtaagtcaaactcggtagcatggcctttaggaaatgttctaaccttccttttcttctccgtacgattattgcaggacaatgtgatagccccaaacatcaataagctaactcattctgatgatgcatttgacttttcaaaatctaagaatcttcagaaatatgattattttcagcagtatggaggttccgcttcttcaagcgaaaatttatactacaaaatgttaagacaattgcaccgcctgttttatctgctgacggtgttgttattaatcactaatatttcggtaacttatagatatcttttcgcgcatttccagacctactcgattttttattggaaaactgttccgaagtcgaagaatgtaaccaaaaaatcacttcatgatttgaaccatacctacgtcgaagacgccaaaagagactctttatgggggatgattaagtatctcttgttcaatgggtctcacgatgatgagacaaatagagcccattattatgaattacgaaaatggacaccaagcaggtttcttacatctttttttgtctcattttctccaattgcattctgtttcttgtggatgacagatgttactttcaaaactcttattccaatcattattcaccaatatgttttatggtttattgttattgatcgatacgagcagaaattgaaggatgagcagattttgagcatgtccagtgtggctgaattaaattcaaaagttattcaacctaaaatgaatgtcttgaagcaagatgcgatggttgacgcaacaccttataacgatggaatagtttacttctatccggcttacaccactacaaggtcgcacgtctttgcaacccacactttgagtgggaaacttagtaaagaaaagtataatcctcgcacagattcattcgaggatgccaattcacagcgtacggaaaactacgtaaggttctcgtaccatcaccctaagtcaataaatggtgcttatgtacgagaatcgtatcctagcagacagcatagtccgcgtttgagcccttctcgctattctcatcttcaaagtggtaatacaccttccgctccctccacgccacttctaataccatctcaacaacctcatttcgatcattccatgttggccaatgcatctagaaatcataatataagtgagagaagaaactctcatagtcctattaaacaacactttgcaaataggttactaaactatccggatgaaacaaatgatagcatacccgatgtgtctgatgacagattcagaatggatgatcgtttcagaagaggcagacaaggctatttcaatcgatctcccgacatcaattctggtacgttacattacgatgatggtgatgatgatgataaccgtatatcaaagtctccctttcggaattcatcgtcttcaccatttcggtagttattcactcaaatactcacattcattgaagtttggtgcactggaatttcttgaggtatccgtaaattatataaacataatacatctctaattactaaagacaatgagactataggtcgttccacccgaataaccaattgttgacccttccaattaaatttgttggttgttggttattcccatgctgttcctgttctcgtaacttgttctccaaatttcttaaaaagtttggaccaccatgaggagggtttgcattatgcacaaacaactgctttccatctttgacatccaatttccgagtagaaaaggtgaacccatgtttattattatcagcactttcttgtgtcccattttgtatatcagatgattcaggtccgtttggtttcatcgataaactgaacgggatttctccgatgtcatcagttttatcgattttgcacgaagccaattgttctacggctgttttgctataaggaacgcagccaattaaacaacctccataaacggtaccattctcttgtagagctctcagagcggcactaggggagtcatacgtgattttaatccatccatcgcccgtgaagataggatatttcttatgaggaattttagagtccttattttgagcacgaattctaatagtagcactggatatgttgttacctgtaacacctcttagaacctcaaggtcctctaaaatatttccgaattttgagaaatgtaatattatttggtttgaaatggattctggatatccaaatacaattactgcgctctcttgcgatttttgtcttgatatatcatttgtttgatccgctgtcggttttacaggggatttcgacgcatctctgtcgaatgcgtttcttgtgctcttagtgtattcttgagtcaaaggtatttggttagacgaaggcattgcgttcacgttagtggggacagacccgaactcatcctctcgttgccaatcatataacgattttgttgggggagcttcattcgattccacataagtcgcgatatcagtaggttgtgcaggctgcgtagagctgaatgttggcttctttgtgccaaactggacgctattgaatccggatctttgggaagagttgtcattcgaagatccatctccagatgagctcggtttagacgatctttttatcacggattgtggaatgtttctctttctagctatattataccagttttcttcctttccattcgtggcagagctctgtactagtgattgtgaactattctgctgttgttggttttgctgctgctgctgaggataatttatttgcaagtttgcaaacctgttctcttgttgcgcttgttggccaaatactgaactcatgatttaggattgtcagttcgctttctcaacaatgtttcaacagtcaaaaatgatcaatttatcctacttgaaattgaagaacacaccaaaccacagtgttaccggtgcatatgaacatgctacgatgataacagctattctcatctaatcttattcttgatgtttattagttgaaattgttttatttcaattagaatactcaaatccgggtaatgtttgccattatgaacagcttcagtgtatgtgtaaatttatacattcacgatcgataagatttacctctatatactgctttttgatgtctccttgtttgcgggagatatgtgtgaagatctgtcccttgttcgtgcaatctcttttttaccatgtcaagttctttacgcatagttacgtatcctagatggagtttgcccatgaaatggtcagcgagtcttctatccgtgtctaatcttgaaaggtaggctccacatacacggcatacctgtagcttctgttgtgcactttggcctgtgttttcgttcatttgcctgcatttttcgctgagtgtgtccctttctgtttgcagtttgttatatttacagctttgaatcatcgccttcataacttcttcgttttgtataagcatatcgatttctgaaagcattaaagcacatttggattcaagctgattcactgcttgtagaagtgctgctaatttcgaatgttcctcatgatgctgtaactttttatgtgccatttcaatttgaacatcacaatcactaagaatcttcttcaagatggagtaatgctcaaggtcaaactcaggatatttcttgcccttctttacatctctttcatattgcattttatgcgagactgaatgtatacgtggacaatgccccatgggctgcttggtctcttggaaaaggtcataggggcaatgaccaatgataaatgatttgcacgttgatggtgaagttagcccatgcgatgtggcagccgaagacataagctgagaaatcagcttgcgctgttctaaaattgcagacatttctcacttacaaatatctctgatggaagtaacaccaaactgttgcgtgcagtttggactctgtgattaactttttctgctctgttggtcagttcaacaatgatacttcttcagtacgccttttcaagtagcttgttgaaaatgccaggtttaaattctgacgacaaaatatactgaaaataaatatataataacacaagcaaaacatgacacaaatggcagtttaggttttctaaacatgatcattcctatcttaggtgatccttttgaaataatttgtagtacaattagaacatgcaagctagaaacaatggagcctgtattttctgctttagttattggaggtaatggtaatgacagcgcaattagaatttgtcgagaattgatattcaaatatggcattaaagttatcaatgcagattattgggatgccagggatgatattctatatggattggaagaatattatagaagtgacgatgtaagatccgataagtggattcttacatttgattctcatatcaacttgatcaatgacagaaaaaaaaactacgagttcgtgaacattaatacccagaactggaaaccgattctttctggcgtgaacgtagttatcaatttgactcagtactatgaacctaccattggtggcttgctttccacaccaattcaagaggtagacccattgatagatttatggtgtcacatgatcgagataatggaaacggtaaggttgacgacccattgcaccattgcgtatttgatcaataaggatactagcttcaacagaggttggggaatttttgccaacagtacgatacaattattggatggaaagctttccgtgtgtcaagaggattacgacgtgtatttctcaccaaaagaactatttcaacagttcgaaaatggaacttatgctgatataatgagatgagagaaatctagtattccagagaagatttaactagtagtgcggaaagtgggaaaacatccacaacaccgagtattatttggtgttagcagtgatgagttggcttaatattggtagctatgtggtacgtacagtttgtttgatacatataactcatacacatttctatgagtttacagaaacgagaggtgaatcaatgttaccgaccttgaatagagtaaacgattacgtccatgttctgaaatggtataaggacggacgagacttaaagatgggagactgtatagttgctatgaagcccacagatccacaatctagagtttgcaaacgaataactggaatggagggtgatttgatattagttgatcccagtcaagaagatgatgaggaagcttacgaaacttttatcagggttccaaagggtcacgtatgggtgactggggacaatctttctcatagtttagactccaggacatataattcgatacccaagggtttaatcaaggggaagatcgtagcagcgaacgatttcagcaagcctctatcgactttttgggggtttagagaaatcactaacagctattttgatgagaaatgataaagttcaatgatgaaataggaatgtttatagaagtttatgttcgtattgaatgtagctatagaagtatgttaatcggctctgatagatcttttgtatttcgaactatttaccggctatttaattgcggaactaagacttgtcgaagatcatcattgtttcaatgacttcagagtagcagaaccaagcaacaaagctggtaagaacaacaaaccagtagagaatacggtgtcaaatattgaggtaccggaatagtacttgtagaagatgaactcgaaaccggaaactagtgcaacaaataagtacgaagatacattcttcaagttgaaattaacagcaccgaaagatacccaggagacaaacaacacgaataaagtggtagtaattaccaatgcaaacagttgagcgatgaacgcattgacggtcttaggtgaactttggaaaatgtgatgaatttcctccttcggattcaatctaacaaagtttctcgcagtatcacgggtatttgttacaggatcaacaatggacaatatgaataattccttaaccaatgaattttcttctgtggatactaaaaggttcacttgtagctctgctctatcgttgaaggcatgtgcaagttttggtagaggaatggctaaggaaaatttgtcagagctcccactttgcttctttaaagtatagccagcttccaagttttcacttggaagtcctaccaaaacatttgcttgttccaactcttggtccacaacaaacgaaagcttcaatgtctctgacaacgataccggtacatttacacctttagaatcatatttactgtcaatgttattcaattggacaaccggcctttcactatcgaaagccactactgcatcttttagcacaatttcagttgcaatacagtactgaacaaacgtcaatgcactgagtattaagctttgaactctcatttcttctcttcgttatatttataccttaaacgaattcctaggaagtcaattacgcaatgatcacttctaatcaatcaatggcaaaaattaataaaaccagtgctataacaaacaaaatgggaaatatcacagatattcgaacaactgtaacaactttaactttacttaattcggtggtgttttctcttcgtgttctattcctattctaaaattgtacgtttgttaattgtgtttttctcttgaatatcagatatactattttagtatgtgaattttattattagtgtagctacaaaataaaaaaaaatgttgtggaatcagcttacccggatacgttgagaaggctgaccctgcctcctgatgacactgacgatgaccaatttcaagtgctatccaataaggactcctcaatggattgtaatgggattgtagaccctaaagtctgggaaggtgctgcttgctcctgttgtgtgaataattcgtcaccctgctgttgagctttcacttttttctcctcttttgcaggctggtttgatggcaactggtcgatcatgcctcttaactgtccttgtaggagtataacgaatctatcgtaaaagaacaaaccaatttcaaacgaggtacggcttgcgaatgatagaccgactgtcgctgaggataatacgaacgaaaatgtgaggaatggaagaacaaaaatcgaggcaataaatgcaattgaaaggaatgtcaccaaatggaaagcaaactgcggtaacgaccagggcgtcatgtatgtaataggaagggtgggaagaactggtctacttctaacgcaaagtggtatcactgcatctagaagaagaatcccaggtatgtatgtgagctcctgttactcttgttaaagcctctctttatataggcagggaaaaacaaaaacttgaaacgaatttgaaacagataattagccgcccagtaaggtccgggtaaattatgttcttaaaactaccggagatgatgattcaatggcagtcaagaaaggaaagtaagtagcatatgttactccacagttgtatgcccatgtgcctaaaaaaaataactgtattaagggtatatatgtttatttgtataatattactccaatcaaagtaccactcctaataaacctgtactggactggtatcaacaggacaatgaaacatgttccaataggaacaactaagtctctaaatattttcttctttttcatgtcaccaattataagtctcaggcagaagtgccgatatattggttgacttgatttgagatcatcttgtagtatttattcacgtaagctgcaatgttcgggtgttgctgcgcagcagcatggagttgtctctgataaatatcgtatatcctatcgtaatattcgtctaagtattctgatccatggatgaagtcgctgtcctggatacatttgaattggtcaatcataccctgctgaaattgctcattgaacttctcttcgaatttctcactcgttaatgacattattttagttagctgacgatagataaggttttgtaatcaagtgcttggggtctgagctatgattcagtatatatggtacgagtaaacttctacttagtaattgtaaaacacacgcgttccctgctcttaaaataacaccaattaaattcccttgtatgtatctttatatatacatataatcctataaacatgagagtaaattctgctcgcacgggtattaacgccgattccaatatattatgtaattatgtatgtgtggtgtactggcgtgcccgtgtaaacctagaaaaaggcttttatcagtccctatcagataagcgtccgccaacctcgcgttccgctccgacgatatcttctatgtttaccctctgttctcgtatatctgtagatatcaaaacgtatcatatacatagctcgttatagaatgctttcttaggcttgaagcgtaaagcactatttttcttctgtaattaattaagaagaccccttgaacggttttaatttgccaaacatgtcacctacagaacagtgtagtaaaagagagaaaatgaaataaagggccaggccatcatagtacgaaaacgccctttgtcaagtccgttttagagaaaaactatcagaacaaatgcggtcgatggtatttacaatatattccatctgtccgatcggaacttttacccattctctgtgtgttttttgacacacttcgcagatgatgttacccttcccgtactctttccacagccattcatggatttctcgctccacgtgacctgaatctttacagcggaatccgttttctgtaaagcatctgtcagatttatttcttgatctgcctgtgtcagtaatggtggtgctggtgatagtagtatgttttacaatgttactgtggttgtttaatgccaaacgacataacttctgaatgacattcgacattgaatttatgctcttgggttttgtagtggaggagacgatccattgacgaactatttcgggcgttattagtataatgtctcgtttgcactgtttttgccattcattaattcgtttagaaacatcacttcttcttgtcatacctattttgatcagaatttcgtctttattgtgctgccagggatcgaagcggttgttacgtaggatcaatgcttgattcttactgggtttcatcttactattgtcggttactaaccatgtaatctctttcctattcttcttttccacgacagcattctcatgtaacgttgcgtaagtatatatgtagatgtattctggggtatcttccggtatatagggtgttttggttgggctggaggttccgttgttttggttaatatgatgtctacagaactttccaccctctatggcttttagcttgcattttgatccctttcgtgtggtaccaacgcattctggggcatcatgcggcatatggggtgctttagttgcaatagaggttccgttgttttgggtactatgatgtctacagaacttctcaccctctatggcttttagcctgcattgtgatcccttttgtgtagtaccaacgcattgcgttctcatcaggttgtctatcctctattcaatgacaatggcaagtatagctttcttttctttgtatccttttcgatctcatcagatggattgttttctaaatgtcaatacacataaatatctatttcccgtcttcttgatagaaaaatctgaacatgtaaaaacaccatcatcagacaatggagaccaagcacagctgatttgaaacaatgcttatcgaacagtgtcaccaggatttaccaacatctttcgattctgaaatcagaatacatatcgtgaagcctaccgttaagggctatccaaatgctaaattccctgctgtgttagtcttctctgaaatttatcaggttactggacctgttttgagattcgctcaaacgattgctgcagaaggttacattgccattttaccatcttcataccataattttgtagattctacacccttggcgtatgatactgagggtactgatctaggtaacaaattcaagattgaaaaacccttagaatcgtatgatgaagatgttacgttgtgccttgatgtactagaaaacctaccacaatggaatggaagagttggtgcaactggcatgtgcttaggtggacatttggccttcagagctcaacttgactccagaatcaaggctacaacatgtttcttccccactgatattcactctcactctttaggtttgggcaagaatgacgattcattggaaaaggttacagccaattggaaaaaggaccaggaatgtttcttgatttttggtaccaaagatactcatgtgccatgggaaggcagagatcaaattagaaatgcagtgaaggataagtctgtcacatttttagaaatcaacggtgctcaacatgcatttatcagagacgaattcagcaaggggagattcgattccgcagtgacaaaagcatgtttgggttttatgtttgagttatttgatagaaagttgaagagtgaactaggagagttcgttgacgacaatgcgcctgtcgagcatgtttgttagacaatgcgatcctttcatgtgaagccaactatacattgatatatctatatacttatacttatactagtgcagcaaaaaccaaaggtttcaaaccagtacccataatatgtcatggaatctcgttctgagatccgtatggacacactctgagagtttatcatcaccaagtgacacagtacttctacttgggatgctattttcctcattaccctacctttaacagatttcttttatcagtaaaattttccaagcgtaagtaaagccagagagcgtattatcacagaggaagaagctttagaaaatgaaaaagtgaaagaaattgatgaattagtgaaaaaaaattcgaaatacacagtgggattaacaatatattttcaagaaaaagcttagagcagcttcagtactggttcaaggattattcggaaccaacagcaatagcagattctgatcgaactcagaagtataaaatattgaaaagatgagaccaattgttttgaagggtcatgaacgtccattaacgcaagttaagttcaaccgtgatggtgacttagtttttgcttgctccaaagatagtgttgcctctatctggtacgctatcaacggtgaaagattaggtactctagatgatcattctggtactatctggtctattgatgttgatgaaagcacaacttatgcgttgactggtggtgctgatttctgtttcaagatctggaaagttgctacaggtgtagcagtccattctgtctctaccagaagtccagttttgagagtcgaattttctccagacggtagcaaacttttgattgtacttgatgccgttatgggtcacattggttccattgttgtttactctttgatcagaaacgaaaacggtgaaatcgtgaatgtgaaggaggaaccagactacgaaattacaaccatcgagcaagctaccaaggtgttcgttgcatcttggtcctacaatggtaagtacatcatagcaggtcatgaagatggtcaaatcagtgcttactacggtgaaaacggggaattcgttcaagcaaagaagatccacgaaaagagcatcaaagatatccaattctctccagacagaacttactttatcacttcatccagagacagtgtcgcttctttggtggatgtcgacacttttgaagttctaaaaacatacaaggctgattgtccattaaatagtgcatctattactcctctcaaagaatttgtaatcttgggtggtggtcaagatgctaaggatgtcacaactactagtgctcgtgaaggtaagttcgaagccagaatttaccacaaggtattccaagatgaaattggcagagttaagggtcatttcggtcctttgaattacgtcgccgtttctccaactggtacatcatatgcatctggcggtgaagatggttacatccgtttacatcatttcgataaatcatacttcgatttcaaatacgacgtggaaaagacatttgaagtggaaagaaggcaacaactgcaaaagcaagaataaacttggtcattcatctcatatcacacatctctttttcttccatcgatacaaatctgatgacaccagtgtacattatccatacttttcacaactctattctggcactagataacctattgacgctcccgtttttcatcattcaatattagtataccaataactaaacatcattagttgcatattattttacataccagagttcttccattgcgaactctgcaaagatgtgtccgtttaccccaaaaacagtgatccacggctattggattcatcgttgttaataactaatgttttcattcattgcttatattgctaggattaatgcggaaacggttttgctagataattatatgtacattcaattacccatgtaaattaatgtaaaataacctaaccttcagacacaaacttttagaagaaacgtcccatcatatgtgagcccgtcagctaaaatgtgtaagacgtatgaaaagatctttaaaacttcagtagcatacttcgttgagagtaaacgtaaaggttttctatcgatgtaagtacttaccttctcttctctgctgccagtttctcaagtctttccttttcctttctttcatttgcagcttgttgtttttgcctcaggatttctgcatcggattccatacgtttcttgggatcaccttgtttcttttggtttttaccgctttcttgttgttttttaaggttcttctgtcttgccagctcacgctgattgcctcttgccattgttcaggtttgatcgtatacggttcttagagaaagcctaaagaaaatacaaaaaaaagggagcaaaagaacaacacaactagttaaagtgtggaggagtatggccctaccagtgagatgctctgtctctgtttcctttacgcaatccaatggcagttttattgcgtaagttgattaactaatatcatcatctcatttcaaaaatacttcaatttataatttccattccaattccatagttttctcttcgagaaacttgtcaattccataagcggtacaattgaaaacgaaaatacgaacggttgaaatctagaggagatcaaacgtgatttacggtgatttatagaatttgtatcttaattcattaacgtcaattctacataaaagtgagagatccttgcgtaaaactattcgatgtgtaaaagtatcttgcatgaaaatgtcaaacatctactgttacttttcaatttggtagtagaacgtaaaacaaccgaataattcacaatatttccttgataaagcgactatttaatctgagctgctccaatttacactgggccggtcaagggctctccctgccaaagaaggttcctctaattcaggtgttgccgcagttcctgaatttcaaaccttactttttgttttcgtattatgctggagtcttattctggaactgttcctcgaccctcacgtagtaaacatccattaagaccgaaaacagaaaacctttaggtagcgaatagggatatcacatgactaacataactttttctctagtctgttttctcagtgaggtaaaaagaggtgctcattggcttttaacgtacatagaaaacattcctacttaaatgtctgctacgattatttatgtatatatatacatatatatatatatatatatatatatgttaaaaagaggtgaataaacttgaaatgccaagagctatactttgatactttattttcgaagatggactttcagcttgatctgttgggctttatttataaccgtagatagctctcaagagatatctggttgtgttctgatctttcatttgtcatatagcttgatttctaatacgttttctattgtggtttattctgcgcttaattggattaatcaatactaaaaaaaatacagcggctagcactattgaaactcacggttctttactctaagacatattacttgacaatcaagaacttttctaataccatagattacttttgaaagatttgctgctggttaatttggatatttttcctttacctgttagtgtagtttgtggcaagatctcaaaaagatggcagacactcaagctttgatttccgttcagggaatgacttgcggcgcctgtgtcaaaaccgttcaaacacaagttggaaatgttgatggtgtcactgagtgtgaggtgtctttgttgacagaagaatgtcatgtcctttttgataaaggacgtactaccacatctgaaatattggaaacaatagatgagtgtgggtttgatggtagcttaatttctgaggaaccgctagattacgatgtgacaacaactgaacaaatttcagggattcttctcgttagcggtatgacgtgtggtgcttgcgtgaaaactgtcactggtcaagtattgaaactaagcggtgtattggaatgtgacgtatctttagttacagaagagtgcaaagttaagttcgatccccatttcacttcgatggctgaaattgccgaatgtattgatgattgtgggtttgatgccaaagtcattagtgagaactcaagctctgtacctagcaacgaaaagcgtttgtgcttaaaaatattcggtatgttgtctgaatcggatagggccgatatcgagtcaaaagtttctgagttgaaaggtgtgatatctatcgatacttcattgcaaagtgaagaggcaacagtcatccatgatgctaacgagatcggaaaccgtgatatcatagactgtatcgaagagatggggtttcaaacttttatttcaaatacattggataattctacacaattatcattactctctaaaactaaagaaatccaattctggaagaagaattgtataagaggtggtatttcttctattctaataatggggttgtacatgtgtgtaccgatgctgttcccagctgtgttgactcatttcccattcgtacaaacaccaattattggcttgttttatagagatatcatcggaattatcattactacctacgttcaaatctatgttggttcctatttttataaagctgcatggatctctttgaaacatggctcaggtacaatggacactttgatcggtctttctactgtttgtgcatatattttttcatgctattccataatttctagcatttaccataaatcgacaaaaatgccaaaagtcatctttgacaccgctgtcatgcttctcacatttatttctttgggcaaattactcgaaaataaagcgaaatcggaaacttcaactgcaatgagtaaactcatctctttgaccccgtcctcctgttccatagttttaccagatggctctaccagggaaatatcagttgaattgttacaaccaaatgatatcgtagaagtcgtaccaggaatgaaaataccagctgatggtgttgttattcgtaatgaaactgaagttgacgaatcgctaatcacaggtgaatcgatgttggtggaaaaaatcgtcggatctcaagtcatcggggggagtgtcaatggacctggtcatttctacttcagagctattcgtgtcggagaagatacaaaattagcgaacattatcgcaacgatgaaaaaggcacagttatctaaagctcctattcaaaaatacgctgataagatggcgggcatatttgtcccgtttgtgatatcactatcagcaataacatttataacttggatgcttgtgagttacacgatgaagactcctcctctcatctttaacagtgaaaatggcaaattcttcatgtgcatgcaaatgtctatttctgtaattattgttgcatgtccttgtgcattgggtctagcggcacctacggcgattatggttggtactggtgtaggtgctagtcatggtgttctcatcaaaggtggtgatgttttggagaagtgtagtgctctacagacgtttttgttcgataagacaggtaccctcacgacggggcggatgagtgtagaaaatttcattaattataacagtgatgtatctgatttacactggaagatgatttcattgtgtgaatcaataggagaacatccagttgcaaaagctattgtcaattatgctgattcccacgtaaataaatcaagcattttcgatttggatttatcgaatgaggaagttctcattggaaagggaatttcctgtaacatcacagataaaaatacttctaaaatccatacaataaccataggtaacaagaaattatttcccgatgagagtttgagtgatatcgcttcttctactttaacagaatcttatgtttccatcgatggtagtttagtcggcaaatttgaaatatctgacagggtcaaagaagacgcacattttgttgtagaatatttacaaaatttgggcattaaatgctgcatggtcacaggagatgcgcatcaatctgctctgaaagtggcacaacaacttggcatatccgctaatgatgtcttcagtgaagtcactcctgagcagaaacgtgatattgtcattcaactccaaaacaacggtacagagagggttgcctttgtcggagatggtattaatgattctccggctttggttgaggcagatctaggaatttcgatatcttctggtactgatattgcaatcgaagctgccgatatcgttattcttgattcggataataaaaataattcgttaaaaggtttggtttatgcacttgatattgcgcgtaaaacattctatagagtgaagctgaatttcttttgggctgtctgttataacacattcatgattcccattgctatgggtttattagctccttggggtatcactttacatccaatgttgtctagtgctgcaatggctctaagttccgtgtccgtggtctgcagttcgctaatgttgaagaggtggacaccgccttcactcaatatcaaatcaatggaagcttccggtggattgtcatggcttagatttggtagaaacagtaacagaggtgatgatattgaacttcaggaaagattgatgtaaccttagctatttacgctattgcaattcttaaatatcagtacttgtattataacattaataaaattcatattcgtaataaacgaaagattgtataatagaatcgctggatgagtttattgtacagtgaaccaagcgctgtgtttagcaattactggtattattgttactcaaagcggtttgtcactacatcgttgatgagctgagttatttatccgggtaacaataaacaataagtaaaattaatcgatgagatgaacataactttagaagtacagatgaatgcatactgtaatctaataggcagttggtacaaatagcgagaagtaaggccaggtactcacaatgggtgttccgtccttttttcgttggttgtctaggaaatatcctaaaatcatttctcctgtgttggaagaatatccagttatcgaagatggtgttcaactaccgcttgattactcttcggccaatcccaatggtgagttggataacctttatctcgatatgaatggtattgttcacccttgttcacatccggagaataagccaccacctgaaacagaggatgaaatgcttcttgctgtgtttgagtacacaaatcgcgttttgaatatggccagaccaagaaaagtcttgatgatagcggttgatggtgttgcaccaagagcgaagatgaatcaacagagagcacgtaggtttcgtagtgcaagggatgcaaaactccaaaatgaagccagagagcaagtattacgagaaagagaggactatggtgagacgattgatgaaaatgtcaaaagtaaaaagacatgggattcaaacgcaattactccaggtaccccatttatggataaactagctacagctttaagatattggacaagtttcaagttagcaactgatcccgggtggaaaaatttacaaattattataagtgacgctactgttccaggtgaaggtgaacataaaataatgaatttcattagatctcaaagagcagacactcaatataatccaaatacaacacattgtatatatgggttagatgcagatttgatctttttgggactagcaacccacgaacctcatttcaaaatattaagagaggatgtgttcgccaataacaactataaaaaaccaaagcctcaagatatgataaatttatctgaagaagagaaacaacagcttattcaacaagattcagaaaagccattcttatggctccatatcagcgttttaagagaatatctttcagcagaattagcgattccacatttatcgttccagtttgattttgaacgagcaatcgacgattgggttttcatgtgtttcttctgtggtaatgatttcctaccgcatttaccttgtcttgatgtgagagagaatagcattgacattttggtggatatatggaagactgtgttgcccaaaacaaaaacctacctaacatgtgatggtacactcaatttggaacctgtagaagctttacttgaacaattaggagaccgtgaaacagatcttttcaaaaagaaatacattcaggaagttcgtaagcaagaggctcatgataggcgaaagaaattgaaaagtaaccccaatgtttcccagggcaaggtcgacagaaattttatgattccgttggagaatatgccggtctatgatgttgatggcaacgccgctgaaggctctttgaatttgtctaataaggatttcgctaatatgcgtaaagaaattaatttggcgaatgaaggtgatggcgaagcagctaaagctttgaaactaaaaagtgagaagaatagcggtgtggtcgagttttcatcggaagaattgaaaaatagcgtgcaactgtcgaagactgcgaactacgatgctgctaccagcttacaggagaaacttattgctaagaagatggcaatgagagatgaggaaaatgcagaagaattgtcgttgaaacggaaaagtgaagatgttgactctgctgaaaaggaaacatccaatgaacctgaggatgatgaggccgattatgatgaagacgaaggctctactgttccaccagcggtcatccacaccggtattgtaaaatcagggttcattgacaccgatgagtcggttagactttacgaacctggatatcatgatcgttactatcaacataaattccatgttccagcaaaagatattccagctctgcaaaaggatgtgattaggtgctatgtggaaggtatttcatgggttttattatattattatcagggatgtgcgtcttggacttggtactatccataccattatgctccttttgctcaggatttcaagaatataaaaaatctagatattcactttgatcttggtgaaccattcttaccatacgaacagttaatgagtgttttaccagcagcatcaggccacgcactacccgaaatattcagaccattaatgtcagatccaaactctgagattatagatttctatcctgaagaattcccagtggatatgaatggtaaaaagatggcttggcagggtattgcactattgccatttatagatgaaacacgtttactgaaaacagttcgagaacaatattctaagctttctgattcagaaaaggcaagaaatgttaggaagaaggatgcacttttgatcagcaacaagaatgtgaattacgacctgtttatgaagaatttatatggagaaaaccccgttaacgtgatagagtttagacatttcaaatctggtttaagtggattcgtaacacaagctgaagaagggtttgaactaaactccaagctgatatgtcctattaatgggggtggtttgccagatttgagtacaaatttattcctaaaactttcgtatacgcagcctgtggttgcgggtagatgtaaatcgttagtattgaacggatatatcccacctcaaccaatgcttaccccacaggaccgagactgtatcatttataaatacagtaaccgttggaatccttccatgatgaaatacaacattgtgcctgttggcccatcggggattacccaatatcagcccagggttggaggttacagaagtttcttcttccataaagaacagacagcttatgctcaacaaccgcaacaaaatagagagtatatgcactcgcaacagagacagccacagggcagcagatatcaacagtctaggtataataatggaaactacaataatagtaacaacggttattctgataataataatggtaataccggcaaatacaaccgtcattataacaacagtagaggtaatagcaatcgatactcgaatagtaacgatagaagaagggaattcagaagatgatgaactgtggacaattttatacccgtttatatcagcacatttatttgtaatacatactataacatcaacatccaaagcatattactgagcaacaggagtagaagcattcgcgacagtgatcagctccacagatactccttttccagtatcatgaacctggatacaaaatacacgtgatttgtagtttcactactgtgtctaatatttctccaactgtataacaattatccgatatagtgtaacggctatcacatcacgctttcaccgtggagaccggggttcgactccccgtatcggagtatttttttcagtttttcaagagaagtcttttttctttttttcactttttatcagcttgtgtacgggctcttctttgccaaacctttgatgatgaaaacctcagctaaagccattaaactcgtgaaatgattaataccaaaaatgttactttggcgttttcatagtagtggatgaacaaagctcatcgcaaaaatttaggagactccgtttagttggagtgttgaaggtcggctgttcgatcacctattcattgcattttttgaccctcactatctcactgtaatggatcttccaataccgaaaagtccccagaacaaacaggatgaagttcaagttccaagttcatctcccttgttacagacaaatgaagaatcttctccgttaaggcccgaaactggtacgcggatagatgaatcgccaatatcaagtaactctacttcttcccttttgagggacaagttcacgtatcaaccggctacgaaagcaagaaatggttactctcagaatgatttatcgcatgaacaagctttaaaagtgttggttcaagaatacaaggacctatcacccactttgattaatgcaattttcaagcaaaactctatgtctatctcctcgtcaagaaagcgtttggaccatattgtcgcctcacgtaccgggggatcgtggagattccaatctaaaacaaacgtgaacccgacacttaacttaaataaacccaactctcccatggatctgtcaaaatctagattaatctcattgaaagagggtggctcctccgggaacagcatcaaaagcaatcctgctattaatttgccctctagaaatgtatccacttccaagataaccatcgaaaagcaaaagacaagcattttcgaccgttactctcatgtaatgaaagtttcgcaaccctcccccgcaagatccatggcggatagaaccaccatgagtactatcaaaaatttatcttcaaagaagggtaaattggttagaggagacgccataaagaagaaacaaaaaatcaaactcagtgatgatgaagaagatgaaattactgatcaatccaacgatgacggagagctcgatactgaaccagaatatgaggagaaagttactgaaagtaattttgatcaagtgttgaagttcttgaatgaagcagatccgaaagatttagctgatcttggtgaaatatccatagaaaaagctgccctcgttataaaagaaaggccatttgaagacctggaacaatttcaacaattagatttccaatctaaatccccttctccggcaccaggcaaggctagaaaatcacaacagaaaaaagacggtttgaaaatacttgacaaaattgagcaatcgatcaagggatataatgctatcgagtcgttgatccgtaaatgttcaaaatatggtgatgtaatagcgaatcaaatgacgaattggggtgttgacttcagttcatccaaagatacggaattgaatatcttagacgttgatacttattcggatgatgaggctaatgaaactataactaacgattctgcaaatgttcaaataatcaaatcttcgaccacgtccagagaaaactcattaggtccatcgaaacgtaaaagaaatgacgatgaagaggagttttctgatgtggactacgaagaaagtgatgatgatgattttgatgtaaaaccaagagctaggacgaagcagaagaaaacatccataactcaacttcgcaataatcaaatgaaattcataaggcaaaaacctaagcttttatcttccgatgttgaattgaaggactatcagcaaacaggtatcaactggctgcacttgctttaccagaacgatttatcttgcatcctagctgatgaaatgggtctcggtaaaacttgtcaagtcatctcctttttagcgtatttgaaacaaacacaccataatggccctcatttggtagttgttccatcctctaccttggaaaactggcttcgtgaattcaataaattttgtccacacttgaaagttgaaccttactatggctctcaacaagaaagggcggaactacgtgatatcctagaagaaaacgaaggccagtatgatgttattgttactacatataatctagccgctggaaccaaatatgacgtttccttcctaagaaatcgtaattttgacgttgtggtgtatgatgaaggtcatatgttgaaaaactcgatgtcagaaagattcaacaaattgatgaaaattaatgcacatttccgtttgttacttacaggtaccccacttcaaaataacttgaaggaattaatgtctcttttggaatttatcatgccaaacctttttgtctctaaaaaggatgatcttgcaaccgttttcaagcagaaaacaagaacatctgacgctgataagggatataacccgcttttagccgagcatgctattgaaagagcaaaaacaatgatgaaaccattcattttaagaagaaagaaagatcaagtgttaaaacacttacctagaaagcataatcatatattacactgtgaaatgactgagctacaaaaaaccttgtaccaacaagaaatcaagcaggttatggagcacagaagaaagattaaagaaggtgttaaaatggaaaaagcatcacgcaatgtttcaaaaaaccttattatggcattgagaaaagcatctattcatccacttctcttcaggcatatttacaacgataaaattatttcaaagatgagcaaggctatcattgccgagcctgaatattatgaaaatggtaatattgagtatatcaaagaagatatgtcatatatgacagactttgaattgcacaaattatgttgcaaatttccctctctttacaagttcaaattacaatccgacgaatggatgaattcaggtaaagttgaacaacttaagtctgtattgcataaaatcattgacattcagcacgaaaaggttttagtgttttcactattcactcaagtcttggacattttagaatttgtattatccacacttaacatcaaattccttcgtttagacggtcaaacgcaggtgaatgaccgtcagtctctaattgacaggttctacgaagatgatactattccagtttttctactctcaaccaaggccggtggattcggaatcaatttggtttgtgcaaataatgtgattattttcgaccaaagttttaatccgcacgatgatagacaggccgcagatagagctcatcgtgtcggccaaactaaagaagtccaggttacaactttaatcagtagagataccattgaagagaaaattcttcatttggccaaaaacaaactagcattggatacacatattagtcaagaagacaagaaaaacgaggaggcccttgaaaataaggttacagatcttttagaagatattatttttgatgaaaatcagtaagtcaattaattggcagcttataaagttgttacacataatgttgatgtataattctagtgaaacaattttctttctgcaatacatagtctgtcgcgtcaattataaagagagaaagaaatattctttataataagttcaacctcagtgaagtgacacaaaatacagcaacatacatcgaaatgcatttcggtttcatatatcccatcaaagtaagtctggatacctgatcaattgaaatattcgtcacaatcacattactaacaaatgcgtgtttcattatttaggggttccttcaattgcccttttactggtcagatactttaaggaattatttctattatgtctggatattcctgttattagcatttatatatggattcgctgttataacagtattggttacctttgggctatttattttgataccaccattcgtgctaatcgccacatttcaagttaacacatggacattaatcattatgaggcatcttttattgaaagatcaaacctggttggcaagaaaaatagacgagacttacagaacagaagcattgagtgtgccacaattcatatcagatcgtgaagaggagaccttttcattttctaactttgttttaagttcattcaaattctttcttattctatctgtttcagttttcccgttagtaccacaactgcttatgatcccttccataggttggcaatatctgaacgcaatctacctaccaaatgagcttcccgacgatatataccggaagaataccttttcttatatagggttcggttttgttgctgcttttctcgaagcggttccttttgtgtctgggttagcatttacttctaactacctaggaggaacagtgatggcattagatatgaatcatgttgtcatcgaatgaagaattaaattgtgatataatgttgaagagcttaaagatactacattaatataacactacgctatcgacgcagccaaagcccgctgctacgccgccttcgttggaagagctaaatttagaccttaataaccatccagcatattcattagaataaatattattatgatcaaataaaatcgtaccaaatataccaagttcacttaagatgggaacgttgaataattcctgccctctgataacgaagttttcttctgtcgatttgggtgttatcagttccattaaaatgtatgcactccattcgtcctcgtcaactgattctaagaacccagggatatcttccttgtatatattgtttccaccaccttctctttgaggttttaacacatagttctcaggttcggtaagggctaacttcttgccgatttcacccaacacagatgaatccaatggatatattttgacaaatgttggtaaaagatgatctaaagattcagtatcggataaaaattctttcagaatcttgggatcagttagtaattgctgaatcttcttggtacctgaaagctgtgttagtaaattaggagccttaatagcataagagatttcaagagttagtctgttttcccaatcctgctctgaaacaaaatcacttggagcgtaacctgacctgaagtaaactaaaccaatttcttgtccagttgtcttgtgatataatcttttagtctcagggtctaatctagttgcttcatggatctcgtgaatggttaatctcacggatttagtatcgtattttgacaagaggttaagagctaaaatgctctgatcaaatacatttctttccccattttgaacaatgaaagccacaattggtcttttattcttgtcagccggttggtacttgttaatggcagttgctaagcctgtagcgagtaattcagctgaaggtgagataggtatatcctgatcataaaagacctcaccattatccgaatagttcccacttttgtttaggtaatcatgaagttctcctacttttgttgaaagaccgccaaacgacacagagacggtgttaaattccacttgcttgatctgattattatcgctgttgatgagataatccgagcggaaaacccccaatgctagatcttgcacgataccgtactctttagctctcttgtacaaagtccagagtctaccggtaaactctggatccgatttggctagcttttctgtttctttcgccaaccaatcattcttgttctgtgaaatacttgcgtacaatgcattgtaaatagtttggacatcaatggccttctgaaaagcttcgtttggcaatggagttgggaataatgtaattggtgctacagttgcaagttctggtttgaagttcggtgggtacattgctagtccattggtaagagcccaccgaaaaatctcggactgaaggccatcctgcaattttttggtagagatggcaggaaactttggataagactctgtagatgacatttgttggagtagctaaggttatacctggttcgattgagagagaataccgtttgataggatttcatctttcttcagattgtctcaagtaagttctaagatttgacatctaaagcccttttcctcttgattactaaagaaaaaacgttctcagtgatgtctgagatacagaatgagaagccataaaatggatcagtgaagtttatgaaagaaacatggaacgacggctagaaagcggtaatgtttagtattaattatatagtatgggacataatggtcagtaagtaaataattgaagaaagagtaaagactataaaaatacaactttgggaaaattacaggctttcccagtaattccaatcccaaatattcattcctgaatctgtagattcattaggagctggcatattaccagctgatgaaggaatggaaggctttgaattaattgagtacattccaagttccgatggcactaatggtttagtttcttgtacggaagatgggtcattcaaaaacatatcgtcaggtgaatcgaatttgacttttttggactcagacattaactcactcgaagaatcagtggggctgatttctaaatcatcgaatttccttttcttttcatcatgcttcggtgtagagttgagtattagttgtttaggatccgcgaatggtttgaaacaagcagtaatgtcagcgataggtattttgaacgaacgcaaggttttctcgctcttgcttggcatcaacaacttgttattccttaccgatatctcgactggatcttgatctcttgccttctgggccgcttttgagagttttttcttacctgtaccattaatctggtctaatattggctgtggagtcttatgaactaaatcgacagcatcatcctttatatccaaacagtccgcaaatgtagacaaaaacaagtcaattgaagacattacaaagacctccttacgatgtttataacgtgacatcagttctgctgtcctgatagccatcttcttcagagctagttcgtcattcttatatggattatcctgctgcggaggagaatttatcatagtcttcggcgaaggcgaattctgttgaccagaagctaagctcttgttattgaacattggggaggagccaggaattacagttggtgtggcagttcttgaattaacaacacttgcattgctgttggattgaggattagaagtcggaataccagattgtgaattcttcttaccctttacagcccttgtagcaggattctttttatccttgtttggagatggaactgctggtgaaatagcgctgaattcaggagagttcaaaaattccatagtattagttcctgatctactagtagcatttagtgaagagtcgaggacgatacccatgtttgaattattgttaacacctgaaattggttgctgtggttgctgttgctgagcagcaatctgaggtggttcttgtgtctgtgattgcattgctaagttcagttttctattctgtaacagctgttgttggtttagtaagtcatttgcagttagattagggttattattctgcatttgacgcattgtcatcaactgttgctgtcttcttaacaattgctccttagtatactcatagtacttttggtatctaaaaatgaccttatcgacaacatttggttcaaccaagaagactcctctgacagctttttccataatctccctagtaagcatcctaatctgtaataactgtctgatatgttcttcatttctagtcaacatgtataatgtaggtatgaagctctcaacactgctgaatagctgctgattggcatgaagttttgatctgatttgttgtttttgatcattagtcaacctgttggtgatatcattaagctttacgggatttttggtaacttctgcatttaacttcttgagagctagcatatcctgttctgttggtcttggaacagaaattttggattgctgctgttgttgttgttgctgttgtggtggtggtgatgattgctgttgcatcattggttgttggatattctgaggggtttgttgaggttgaggcttcatgacaccagcgtttggaataacaggggttggtttcattcccatagcttgtcgtctagactgagcttgttgggattgaggtggctgaacttgtggttgttgaagaggagcttgctgaacctgtggtatctgttgttgtctttgttgttgttgctgttgttgctgttgttgctgttgttgttgtaacagctgagactgctgttgagcagaaccaggcattgggattgggattcccaactgttgcattttcttcaacaccatttggttcatatattttttgatataaagaagctgctgttggctatcgagatttggaggcaactttccggacctttgcaaattttcaatcatcttcttaccagcttcataaagcattttctgttcagcttgggtgaagacctgattcaatcttcccaacaccgctggaggttcttgatgctgaggttgctgtttatgttgttgttgctgctgctgctgttgttgttgttgttgttgtcgtacctgttgttgctgttgaggcacttgattcatattcatcctttgattaggagattgttgcacacccattcccggttgctgaacagaagtattcattctgttaacatttgattgttgaagcttagatttgttcaacaattgctggtgcagttgataaactttcttggtgataatcaaatcattctgagaaggtctattcttctgtgcccaaaaggtaatctgaggccatgttgtgatcccgggaggtaagttgggtattttctggagtaattctctaggaatttccgtaacctttagctcattggcgagttgctgttgttgttgcaacgtcaattgtggcctcatcatgttaggctgctgctgttgtggttgtggctgttgtggcattggctgctgctgctgttgtccagtgagcgtgcttctaatttgcctttgagcctgctgtctagcctgtgcctgttgattcaaaaacatctgagcattgatattagccggaatgccattcgcctgctgttgaccggaaccttgctgttgcatatggtgctgttgttgctgttgttgctgttgtctctgcacagcttgtgcttgcgcctgagcttgagccagcttctgtctctgagcctcaatggacttcctcttagcagaatccatggcagcaatccgtttccgcatagcatccaagtacaaatccttagaattacaactggcatacaggctagactcaaactgttcggcactctttttcaatttctccaaattgaaattcgccttttcaccaccgttaattcgactcatatcggcaagaatctgcgccaattcagtaacgaactgacttcgttcctgagtcgagatagtgcttctccaatcgtccattatagaggtgattgcacttctgcctcctattgagtttcttttccgttcacaaccagtgtgagacccctttagttttcactcttgtctacctctctgtagtaaagaaatgtaaaacgatatctgttcttttatttcttagcgtttttttaattttggaatttattttttttttttttaaatttcccaaaatttcggtagaccactttatctttctctctccaatggttatattataaaactggaaaacacagccgagtgatgaaacgttttactctagacaataatccctggctacttcttatcaaagcagtatatcaacgacttttgttgtagatttgaccctttctgtctttctttctttctgtctttctttctttctgtcttgctcccccaaagactaaaactatttactttatttctcaaagtgtgtattgattttccgtcttatttttcttgattgtaaaactggaaactccaaatacagttataactccaggcagaactattgaaatgacgaaccaaaaacaaaaacaaaatttcacaatcctatctaaatcgtcccgacctgtgattaagcttcccttctaactctctgtatgtgatttattcgctcaattttgatccagttaaaagtaataaaaagcgtcttgttatattgttttgtataccccgttttttatccttcggcttccacacttcgtcgatcctagcctagctctgtatccccgagttctagttccctgcagttcttccaactcttgaccagcggctgaacagaagtgtatcccaagaatatacaaagagataccggcaaagtatcacgctgcacaaagggttagaagattaaaaaggctttcagtttagttttatttcaattttttttctcaagtttccttgaaattaatgctcacctgtttgtcctggtgtgtcagttccaaaccccagccactgctgcgacaatttctgcaagaaaagtggacatcggaagtgggcaggaaatttaaaaaaaaaaaaaaaaaaagagtgttaggaaatcgaatcaggaaatagatattgattgaatttggaaaggatttctttcgttgatccatagttccgattaagaaaactgtggaggcttaacttatatcataggtgtagatctatagctaaagttggagataggagaattatatatgtatctagttcaatagtgtaggcagatcttgtgcccactggcagatggctatggcatgagcagagtatgcaagtgctgatacgatgggccatgattccaactgtccagcgacaagtccgaatgcgatatattggcccatcatcttgtaaaatcttgtttctctttgtaagttatccactttcaggtatcttaggtatggtgcccaatatagtcttgttatgaagggtgaaattagggtatggaagatgaagggtcccaagataggaatcgatgagatcagtaataagccacatagaaccacgaatccagcgaagtattctgtcaatttccagggtaaatggttgaagaagaaatatgtagatgctaacgggtaataatacttgattggctggtcattacctgcatctatgatgttcacatccatgcttctgattgccatcccctggtacatggtgaacgagttcatctgtgacatacggatcgtcatcattgtcaacatatttgtatggaggaacatgtggatccatgcaacgatcaatccgatggggcccaagaaaacggaaagtggagtgtacaccggtagaattgtcagtagatatacaaaggtgactagcgcatacaatagtaaataaactaccattatgggaacgctggatttccaatactctggagtgctgagtaattcccagtatgagacaagcggataaaggtatattcctggtgtggaaagtccaggcacgagactcgctaccgcatctttgaaacgacgtttcaagattttgatcttggttttcgcaaaacgtactgtataatcctggaccccaagttcttctggcggttctaatagagtatgcctttggtctccgtatttgtatacaagacctccaaatgcgcaacagatcaacgtgccagcaaatgacatttttcttcttcgttattgtttttgctgggtcaaaagtatgctattactacaagaacttatagtttataacaagtggtcagttcagagaattacgatgtatacggacttatatagggtgatgtggttcttttaatcctgttaatttctggcctcttttgtgtcaaaataagtttgtatatgcaatataatcacgctgttgttcattatttaaatatcgcgggggccgcgtcagtgtcacaaaaaaaaaaagtgaaatgaaatattctgtagtacaaaatgaggggcaagagcgaagtggaagctagcatcggtttccgaaacagagaccaattccaactatgtagtgcacgtttccgtcccatatacaaaaaaacacgagtccctccttctttgaagctgcttttctacttcgcgtggcttgcgtcttctcagacggaaatccccgacagcgccatgccccatccctacgagaaggaaaaacttcccttttactaccctgactcgattagtgtttttgtttttccctcccgtatgttttcttcggagaatttttgaaactcgggaagaacaatccgcacaatgttactgcccaatccagtaatgaattccatactgctgttacccgcgcatgaaatgacgaattggcagattgactgggtttcactgcacgaagtgcaaatgatcacgtgctgagtttatttcttttccattctctgtcttggatttgaggcattgatatagcgtgagttggaaattggttttgatttaataggtattagctattgtagggtttatactactgacagttaggtttctggacccagtaccgtcccctattttttactcaacaattgaccattggtttaaatggctcagactttaattgaaaactataatatacatatctatagctcgtctgttcagtagaggaaacgagtggttcctacatgtgaaacggggatatctaggaaactggcatcccagaaataaatcaaacagtccaatttctatctcgtaaataatcctcaagaaaaccgggacgtctgacttcccgttgcaagccacaagttacgtttcttaatggactctttttcttcttcgatttttcattcagcccatctcactattgtactgctgtttctgccttatttttctttttacactatagagagtatatatgctttttctgatatttcatatcattttggatcttcaaccagaaacgttcgacggattttgataacttgaacccatttttaccagtcgctaccttctaactgttacttttatcaaatacagataatagtactcatttcataggtctgtaaaagcgttagaacaggtctatatattggttattcggttaccttttcatctttttttctgaccgtgtgtttcctcgtttcgttgtattttcactgatttaatttaccgagccaaaacttttctacttctaaaacgaatttcaacaacggagaaattaaatgtgaactcctgaacttcgaaatagaaaccgaactttgacgcttggaacaaaagattttaaatctggatagtatatctactgtaaggtaattgattcacaagtgcgctagctttatctacccatattttgtctgtttttttttgcacctttgttatgccgtttattggtgcttctaccgattcgcgtagtgggtttcatacactgatggaaaaacattcgagagcctcaacaccagtgtcttccacttcaagttttaaacgtgccgccactggcacttcaacggcagagttatcttctgcagatgatgatacacagagtttagcatcattttcgaggcttccgactaccagtgacattattgaacagccagaaccaattaaccaattgaggaaatcatcgacgatatcaactatatcttccatatcgtcatcgtctaacggttctattttcacagattctgatattagagaactcctgaggttcccaaattcttcaacacatgcatattcgtacaacccattatcaccttactcgttgtcggtacggctaacgatattgaaacggtccattgaaattatgatcaataatccttcacttttgagcgattctgatgagcctcatacttttgttaatatcgacgaagctaagaaactaattcctcagaaatctcaactacagacaccggtaccacccaaagtactgcgaaatgcttcatcagctgcattatcggcctttttcaccaacaagaatcaagacttgtctcctgtaaaaactttggttagtttgaactccaaaaattcagcatcgtcaaatcagctcgataaccaacaacaaaaaggccttccgacatctgttaatataatacgatcaagctcaaatcctttggcaacaacttgggagatcggcagtggacaaacaagcgaaaatactagtgcatcttcatccaggagaaattccctcgtttctaatcttcaatcatcgttaaatgatcatctaacgaacaaagcacctccttactatggcgacactgcaactgtcgattatgaagagaagaaaaaatctgatcttgaagcattgctagatttactcaataaagctttgcaaaataatacggatgatgctgcatcaagtcttcacgagatgtcactattcaacattaataaacttgccataccgtcaccacctaacaatggaaatggaagcggtaaatatgttgataatggagcaacaacaaaatatgacatcaattacgacgcacatgatactgcgattaagaaacaattattggagagtttggctcaaccgttccatgaaatttataacacaagggaagctttgatggacgaaaaagatcttgaatttaaagtggaagaatattcaagagatccgaattcgttaataaccggtaatagaattcttcacacattcacgtcccaaaagaattcgtccccaaaggcaatatttacttgttctcagcagcacccttggaagtttagagcagcaaatgaccttgcatgtttgatatttggtatatcaatgaatgcaatgcgtgctctaacattattagatttgattcatagtgatagcagaaactttgttctcaacaaaatcatgactacggaaggtcaagagcaggtatttacaggagaaattgttgggattaagcaaccgggacatgcttcctctggtctaatttggtcatcaatctgggctaaacgtaaaaatggtttaatcgtatgtgtattcgagaaagttccctgtgattacatggatgttctcctaaacttagaagactatagcatcgagaacgttgtgggtggagaaggtttgcagtatgatacaaagaatttctctatgaaagagcctcaggaagttgatggcacaggaaaaaagtcagtaaagttcgaacatcaacttcctgacgttgagtcgattagtaaatctctatggcaggttgtaaaggacgttacttcaggtaagttaatgggaccggacgatgatttactaccaatgccattgagagttgcaaatactataaacgatatcaggtactatacattgaattacttggaatataatattccatgtgcagtttcatgttctatattagataccgaattaaagcttaagatacacagcttgccttatcaaacgggtgtcttcattttgaacttgcacacatatgagatggtctcctttaacaaatcgatatctaaaaacatgtttggtcttcattacgcggaattggtggggaagagcattgaagaagttatcccatcattcccttcgatgattgcttatattaagcgaaactacccacagtgggatattgctttgcctacaaacaagggtttagtgttaacggagcactttttcaggaaaattgattgtgagatgcgaggaaaaggagaggaattctatcactctattggcttgaatgctctacacagagatggatctttcataaaggttgatgtacaattgcgcgttatcagttggaattacatggtgttatggataacttactcaagagatcttttcgggaaaaactattcttcaaatccatctcaattgaagattctcaacgaaaacaatatcaatgttgtcacaagtgccagttcggaaggttcttcaaaaaccaacagtgagaagatttcagtgactgatttcaagcaaatgcatgatgatttggaaaagatgaatctgagtctagaaggaagtactgtcggctcgcatctggagaaaaatccaatggaagaaaagaaggaggaaaacaaagaagttgaagaaacagaagaagttccggacgatgatctggaattgaaagcaaaactagaagttgctaaaaggtttcatcaggacaagtcacagtttgttaaagatgacaatttcaaattagacaaggaacttattgttaatatcacatcagcttctccacctgcacaagatgaccagtacaatatggattctacagcttctgacagttcaattcaaacatccaacacttcgaaatcctacgtgatcggatctcagaaacataccaaaaagttttctgacttccttgttttacagaagatgggagaaggcgcctacggtaaggttgatttatgcatgcacaaaaaggataagtacattgttgtcatcaaacgtatctacaaagaaagaattcttgttgatacctgggttagagatcgaacgttgggaactataccatcggagatccagattatggttacccttaatcggaaacctcatgaaaatatactgaggatcttggatttctttgaagacgatgattactattaccttgagacagaaatgcatggagaaacagggtcgattgatttgtttgatttaatagaacttaaaacgaatatgactgaatttgaagcgaaacttttgttcaagcaagtcgcttctggtatcaaacacctgcacgataatggaatagtccatagagatataaaagatgagaacgtaatcgtggacaacaaggggtttgttaagctaattgattttggatcagctgcttatgtcaaaagtggtccattcgacgttttcgtcggaaccattgattatgctgcaccggaagtattgggaggagagccatatgaaggtaaacctcaagatatatgggcaattggtgtattattgtataccataatttacaaagaaaatccattttacaatatagatgaaattttagacggtgacttgagaattcaatctacacacgaagttagtgccgaatgcgttgctttaataagaaaaatacttaaccggtccgtctcaaaaagaccgaccattgacgacatcatggaagattcgtggcttcaattataaactttgcatttttagttattatgtatgcttatatactttccaaaattcacttgaaaacatgcacttccagtattagtttggcataccttaacatttaccctatacctgtttcacttttcaacgatctgatacattataatgtttgtcaatatttttaacaaatctctttatattcgaagtttgaagtgcttaattttcgttttggttacgaatgtcattcactatttaagaatataaaaaatgtccagtttgcaaagtaatatacaactcatctgacggtgtaatcatcaacttcattattatgtgttgctgagctgtacctagaataactttttctcactacaagtaaccaatataatgcccctacacccataattgatattcctgtcactgggaatacccaatatgaataaccatcattttctacactgccattaggaggaacaaacggaatgacagctaggaaaaggttggatataatgaatataaccgtgactaggtaccaacttgaccatggcgtataaatatcgttccaaccaccatcatttgtccagtggatatatattaacccgattccaatgattaaattaaaccaaccgcttggatatgcataaagatcgatgattaactggtagatattgccgtttggtggcagaagtagtacgacaatggtaatgaagcagtgtaaaaacaaagcatagtttaacttactgaacagatgcgtcaaagggaatataccttcttttgcaagttcttgatttactctagcatttgagaaactaactgccatgacattaccatagttggagagaataatgcaaaacggtaagacacgggacactatctgcattgccaacgatttagagtacctttcaaaaattctttcgaagaagactccactgattaatatgcccgtatcagaaatttcagctttgggtatcacaacgtaatatgaaaagacaattgcgatgtataaaaatgtagttaaaccaacagatactggtgctgcaatcataagggtcctgcgcgggtcttctaattcttccaagacgtaattcgcgttctcccaacctttgaacgaataaatgacctgcaataaagcgactgaaatggaataccaatcgagaggttgggagccattgctgaaactgttgtgaaagttatcccaatgtggctcaataagatttggagcaattatagctattgatcccaaaaatacgatgactccaagtattagaacttttaccaaccctagatatagaatcactcttttcgctccggtaggaaaaaagatatgccataaggtacagcttattataaccaaagaaccgatatatctggatgctttatcaatgactgtttcagacaggcttgaattgaatcctaggacatatatgatgtatttaccaaaggcatacgagtttccagaactaaaacccaacaacacgattgtgaaagcataaatgcactcaattagatgtttgggtttcggtagagtcctgctcaaatagttcttttcacccccagacttgggtatttttaatccgaactctaaatatacgctcaagccggcgaacgtaaatatgcctccaagtacccacagaattaaagatataccaatcgattgctgtgagagtgtaaatattaaagctggtgtactgaaaatgccggttcctataattctgttaacaatcaatgaaatagtgtgaaaggtgttaagtttatgctcatggggattaataatgtaatcttcactaatgagaaataggtcttggatcggttcatctgtgcttgctatctctcgacgatcttcgttcggagatgacattgtagccccttattgccaagatgatatctaatactataaggggaacctctaaaaacatccaagacacgtaaggttacgtgtcaaaggcccattatcaggttcatcttaactcatttattgatcaaggttcataatgcagcttctataatcttcttccatttcatgaagtcaaacaatatcacgtgctaaaatcacatatgccaataattaaggaaggctatcccagagacaccataagataccagaatatattcaaattagtctgcaacaggtggtgacgaacctgcggcgttatgcaatcgtaactctattgaatttatgtcagttcatagtttttctattccaagggcataaccatcagcataaattattttgatagaaatagctttacctgaaccttcttgagccaagtaaaggcaagagtgaagataaggggttcacagataatgagaggttagtgtccaataaccggatagaatgatgagccagaaaagttttcaagtggtcgacacgacgaggttggaacagcttcttgatgatgatcggttcaggttgaatttacaacctgttgatatagagaaagagcatgcgcaagaatgcttagatctctatgtaaaaggtgaccttaaggaatgtctcgaactgatgtatgaatatgggctgttgaacagcaacaagatgcaaacgtccttaaaatcatggcaattaatgatggactgcgtgagtcaaatgaataatgttggggtaatcggaacgagtctagataagcgattgaaggaatggttcaccaatgaggaattacttctaagactaatcaagatgaagccgttgagtgatcaattgattatcacgtaccaattcttctattcttccttgaaattttggaagagaaacgttaaacaaaactatgaacacatcgatgaattatccatttcatgcaaggaactactcttacaaacttcaagaagatgccaaacagtaactgagattcaaaacctaagtcaaatactagatttcttgatatttgacgttcaaatagaaacgttacaaaagaaggccagcatcacgatgtacactcgattttgtcagctagacgacaaattgcagagcaagctcaaggcgaacaaggtgaagcacgctcaatccgtggatatagacacctatttccgcgaaaaactacaacctaaaccaaagccgaagccaaaatcaaagagtagatcgctgaagccaaaaaatcaagtccagatcggtgcagcaactacatcaacgtcgacaacagccgtaatagcacctgcatctacgcaaaggatgaatttgtcctatatacgacgcttgacaacctatctacctagatggttacctgtctgggctcaatcggtacaatggtcaccgcaattactggcatcgcttattatcttcgcaatatcaatggtactaccccttgcaagaagatcaaaaacgttcaatatcatatggatgcacagcaaagataaagcatccaccatagtaagacttttcatccatgcagtgaacactttagcatcgctatgagatgcctacgcacatattcatgtatctatatatttatccaaagttaccctacacaacgaacatcttcattaccctaccgagaccatcaatcacgtgactttgggttctctccccccttcttgtccccttcctccctcataacgtcagtggaaggaaggaaaacttgatgaaactgagatttggattgtttggtgagaaatcgatgaaagtcgaaatttgaaaataattaaaaatatacatttgggtttatcaagaacaaaacattagggttatactatctttgtatgttttcacaattggagaggacacaagagggcagagaaaaaggtttgggcttcgattttaccagaagatcaggaatttagacagtgtacttatatttagaggaacgagaacggtgtggtaagccaaatatctaacaaatttctttctcagtttcaagaataaatttaatttccgcaattattacccaactttagacaggctcggggaactttttagcagtgtaagaaataacatgggcgataatagcgacagtaaagtgaatctctatccattagctttgctaatggatgaattgaagcacgatgatatttctaatagggttgaagcaatgaaaaaactggacaccattgctttagccttgggcgttcaaaggacgcgtgatgaattgattccatttctaaccgaagtggctcaggatgatgaagatgaagtgtttgcagtcttggctgaacaattaggtaattttgtgccgtttgttggaggtagaaaatatgccactctgctattgcctgctttggagattcttgcatcaaccgaagagacgttggtgagagaaaaagcagttgattcattaaatatggtagccgaacagttgactgaggaacaattgctgcatgattttgtgcctttgattgaaaatcttgccaccaatgaatggttttcttccaaagtatcagcttgtgggttgttcaaagcagttttcgttagaattcaggatgataagtttagaaaagatttgttatcgttgttcttgcaattgatacaggatgatactccaatggttagaagagctgcgggcagaaacttacctacccttgttgaccaattgactgagcatccagaattgtcaacagatgacgaatgggactatatctctagtatgttccaaagattggtcaatgattctcaggattcggtgaaatttttggctgttgatgtcttgatctcaatcttgaaatttttcaataagaaaaaggacttcacacatacgaaggatctattacaatcttccattcaattaatcggggacgaagcatggagagttaggtacatggctgctgatagattcgaggaacttgcttctcagttcgtttcgaatccacaatatgtcagcgaattgttagaaccattcttagctttgtgtcaagataacgaaagtgatgtcaggaaagccatcgcaaaacaaattcctggctacgcaaaattgcttaatgacccatctgttatcttaaatagaattatacctgctgctcagaatctaagcatcgatgaaacagaatgtgtaagggcttctttggctttggagattacaaacttggcgcctttgctaccaaagcaagactcaatggatagtttagttccaatacttctacatatgttgaaagatgaattcccagatgtccgtttgaatatcattgccaaattgaaaatcgtcaatgaatctgtcggaatcgaatttctatctgagaatttgctacccgccattacagagcttgctaaggaccccaattggagagtaagattggccattattgaatatattcctcttctcgcagaacagttggggatggaattctttgattctaaactaagtgatttgtgtctatcgtggttgtgggacggtgtttactctatcagaagtgctgctatcacaaatctaagtaaactaactgaaatctttggttcagattgggcacaagaagaaatcatttctcgtttactaaagtcggacactcaactgttagaaaacttcaactatagaatcactctactatttgcattaactgggttggtccccgttgtctccacagacgttgttgtcgaaaagattctaccattcgtaaatcacttatccacagataacgttccaaacattagatttaacgttgcaaagttctacgctgtcatcgtagaagcgttaacgaaaaatactaataagaatcacattgaactaatcaataataccattattccaacactagaaaaactatgtcaagatcctgatgtcgacgtaaggtttttctctgcacagagtttagaaaaatgtaaatccttcttgtcctaagcgtagcagaatattatagggcaacatctatataaacatgaataattatcacatttatctacactttactatggcatgttttaagtggcggcatagtactagaattagtactagaattagtactggatttgttacgcgcgatatctaattatgtactcaataaatcagttatcctcggttttcacttcagtattcgattccgtagaggtagtttccgcacttctatccacatcatcaatctcattctgcgagagttcagctgctctctcttttctaaggtaatttatccattccgtgtaatcacccctgttgctgttcttcaccgtatcttcaagctccaaaccgactagtttcagtaattttttgtcaacccctgggcaaatatcgttcacaagacataattcacaccttttgctccttggcatgcagagtacctgtccaaagcccaccaatactggatttatttcataccacaaagatctcggtagccatgactctaactgttttctagtatgttcaggtgtcttacagactttaggatcaacccacttccacatctttgcaagcctatcaacatgaacatcaaccccaataccatcgatcttggcccacgatttttgtaaagctaaatatcccattttcggtcctactcccggtaatgacatgaagccttctattgtggtgggtacatcaccgtcaaattgatctcggagcatgacagcagcctttttaatgtaggaagctttccttgtgtggaacccaacgctgtaaatttctttgtctagaattttctcctcaatcttgagtaacgagcccaaggtgataccttccggatcacctaactcctccatacaatattccattatattatgcatagccttggcatttacctcatctttggtctgtgaagataacatcaaagaaactaaaagttgtaatctgtagttcttaggttgcatatttgactttgatattccaaatacaccgtttatggtaattggcagcattgcacatccaacattgtctactggagtctttatcatcgatctcataaaccttactttcgagtatatcgacacaaaattcgaaggcatattagggttgtcctcgatctgaagctttctattaagggagatgtcatcattagtgaatttttgcacatatttaaagtactcatctgtacccatagtttttattgcctcgatttcgggatccgttttaatgtcatggttaccttccaccttaactaccacttggtcttcaggttccttcttgaaatatttcgacacagtttctaattccacttcaacattaactcttggtctcttagcccttgtcattattgctcctctgcttagtcctgataataataggatcaacgtgagttgctttgttctttacccttatgtgccatgtctcattaatcatctcatcgcatctcgtttcttgaaatctaaaatcgggccagtataagaaccagaaaaattactgaaaagacgaatcagttatattttaaggaaaaggataccggacaagtaagaactttgtaaatcgtattacagcatgccaagggttttatcagtttcaaattgaaagtcatcatatttttaagtattataatctggacattgggataccttggagaatctgcaatgtttggacggaaacttttaccagtattgaagaagcttcctggtaagacaaaaattaagaccccttcgtcatcaatccaaggaccattcaatgacagatttactatgttgacatacaatatgctatccccgtattacatgtggccacaggtgtatacatatgtgaaggatgaatataaggattgggattatcgacataggctgctggaacatgagctattttacaagtacaagtcagatattatttgtttgcaggaattgactacaaacgattacaatgagttttggaagaaacaaatgatgaatagaatgaactacgggtccaacttcaccgcaaagacacctcccaaatattggacgaagcctttggaatgtatggatggggtaggaattttttacaatttggataagttcgagtacctgttttccagcagtttatatctcaatgatcttgttggaacgtttgatcaacaggagttacactacttaacccatcataatattacactcacaaatggtgcgggtgatgttattggcgaagatagtttatataatgtggctaaggcaagaaaccaagtgtgtcttttcgtaatgttacggcatagggaaagtaaatcgataatcgtggtaattaatacacacttatattggaaatacgatgaagtcaaattagtacaatgtttgatcattatgcggaaacttcaacggataattaaaggtcttttaatggggattgaaggagttacttactcgaatgtcaagattttgtttagcggagatttcaattcgtcacgagattctcttgtcatcaagtttttaaacggaaaaataatcaagcatggagacattaacctgcaaaatccaatgagagcttatttgagccattccatctacgacgatatccctgaagacgcttacgtccacacatgttattcaggcaaacttaagggcattttcgactatatatggttccatccaggagattttgaagtggaaaaagtactcagcggccaagaagtatcaaaagaactaacccatctaaatgatttcggtctccctaataaatatcatccgagtgatcatattcctgttttaacggaactaagaatactatgatttttttgtcactaaaacacagataggatccttgaaactgaaagagtcaataaaaagcggtgatgatcaccaaataaggaaaaaattacaactagatcactgatccttaatccttatcatgcggtgacacattatcctttctctttcaaatgcatgctttccttcttgttcttcctcatccctcacgcagtagatatgcctttttttcgcggttaaaaaaagttttacagaatgaaaaattaatgaaaatgtaatcaagatgaggttttaatgtctgtgcaacaagtttggagaggagtgactaaacacctaagctgtagcctgttgattcgagttatcaagttaatataatacctaaaaggtttttggatactttcagtttattttgcatatagcgatcctaaagaaactgattactaggtgttctacgtaagggaaacaatgaatcatattttgttacaaaccttgaacaaggatgtttcgacaccacagatacagcagcaacaactcaagcctctgcaacaacaggcaggcactagtaaccgggtaggatctggtgtggctttcctcatgggtgacccagtggtcagagatgctaggatgaggctagacatcaagaagtcattttgtgatgaccatatgttctaccctgaaagcaagtttggctggtcaacagtggcaagcaacaccaatgcgagcgcatacattcctgtaggggtgcgttcttatggtttatcaacatacaatcaaagagtttctcagcatacgaacttgggcggcggtgtagatattagtgacacaaattcgaacggattggcaggaccggttcctcacaacacccgtcatgtgtatacggggcagaacttcaatagcatggaacagcacaagcaacaacagcaagttaacccttatctgctgtccaataacgtccagcagtcctttaacatcaacgataaccaacaaagctattacggtagaagtatgaaaaatggcagtagcaatagcagcaacaattataataccaatagtcttggaggatcgcataccatcaataacaaatggtaatattccggtttattttccttttattcagaataatattattagcattcagattctctacgttgttcgtttcttattaatcactataaagttttccacttagttgctcgaaatgatattaattgttgtggaaaagggttttcattgtttctggttatttgagcttcagttctaagaatagtatttaatagcatgtatcctattcattctaaaacaccattttaatttaatatttgttctccaataccattccgtatatcaaattataactaaaaggaatagtattatagaaagaatcacaattaggaagcaagggcctttctcacgagctgttgcttcgtaagcattaagtcttctcccagccctttgtaaatgactttcacttcgatctacttggcgctcaatatccgttaagagatgttcattttgctgttctacctcatcgttaatctcgatagatattccttgtgtcctattaatagaacttgacaggttttctagatggctctcttgttccatcaattgctgctgttgttgaatgaaaatatcctgatttgaaacttgtggagaaatattgtattttggagttcctgtctcttgatttccaaataattcctttctcttgacctccaataaatcatctacaactgtagatgaagactcatcatctttatatggtttaaacttctgttcgggttctttatgctcttcaactaatccgtctttaaaccgtaccttctttgtttctctcagattaggctttcttttgaatctatagagttccttgtcaatgactgtttctggcaagccttcaatgatatcattataagttttaatctgatgattaaatctatcatcttcagaaaagggtacatcatcttcataatctttgagcaaatcaagtgtatggtttatatgtttcttaagttttatgttatcatttttagatggttgcatgtgaaggacatccattaacctgtctctctcatccacaatctctattaatttatcgatttcatattcgaccttcaaaccattcatttttttatatctatcgtccctctttctctgtagataatacgcctaacattaagcttcgcataggtgttggctgcgttaggttacgaaatgccacttatttttaacacgagctgtctcttatgccaacgaatcacatttaaggttctccggtatatagcataaaatatcgaatagtcaaagaattaataggacaaaagagattacccggaacaataattgacagtaattccccagttgaagcaccaagaccaattgcaagccaaatcggagatacaacaagtgtctgtcttattgaaaagttggattatttatccatatgtacactatactataattgttaaggttgtgctccattattgagcattttgtttcttaaaagctatcgaacgcttagtaactcttcctgtctttgatctgttctttgttctttttagtacaggggtggtttctccctttgaagctcttaaaccctcaattgtcaactcttcacctagcttagccctatcagccttacctaacaccttcttagctcttcccagttttgtcctttgttggtcgtttaatttattattttgtagggaagattggtttccttgggcctttctcatattcttgcatctagaaattcttagctttctggccttcttaccttcatggatcttcttttcatgtagtagtaacgctttactcactgattggaagtccttaaattgaacgtatgcgaaacctttacccatgttcgtctttgaatcacgaataatacgaacatattcaatgtcaccacaaggttcaaagtgcttccagagactttcttccacttcttcaaaatccaaattacccacgaagactgatcttctcttatcatgtggggaggggtgtgtaaccgaatccactctcaaatgatggtcgttgaacactttaccgttcagatattggcacataatcttgaccggattggagctcccatatacggcatatgcgttgatcgaatctctagatttgtgaagcttttgatgaacaaatgcaacttttcttggcaatgcttcttcgaatgcaatggatctgaatctgatactttccacattaaacttaacatcttttgtcttactttcttcttcttcttcgtcttcttctccgtcatcgtggtcatcattctcgctacggggatccttggagagaagtttcttaaattctttgtaaactttctttgatgtgataacctcatttggtacattcccaataaaaattgttctctcagccttggctagttccttttctttcaaattgataactttagcagattcagattccgtgccggtaatcgaagacttatcgactgcagttgcttcatcttcattatcactatcggaagagtcgtccttaggttcatccttaggttcatctttagatttagaatcacctaataccttagaataatattgaacttccaaattatcattctcttcatcattcttcttggtcttcttctttttcttcttcggctgttcttcctgttcttcctgttctttctctactccttcggagacagtagaagcactttcctggacattctcttcttcttgttcatccttatcctgttcaggctcagttagcacagtcctagctttcgactttactttacgctcatcgacatgattaggtttggagaataacgctgcaatcgatgatgtacctgccgcgtctgatttggaatttccaaataaattgttcaatgcggacatcccgtaatataattttggtttgttatgtttgaaagaccctggttcaccaacacaaacgttattcctctgcactaaacctgctggtggctgtccaagtctcttcgatgcgatgagctttatccatttgtctgttgaattatcgaaagtgaaaaacctgcacttcctagaaaagccagcagaaatcatgaatttaccaccaaaaagaaatgcggaagaaaagcgtacgctctatggacaaatcgaatgtatcgtagtcacgtgattaacaccgtggaatgtactatatggccgggtaacatcatgttccttttccttaaaaaacgtacaaactgtaaatagtgctgaaatgccgaaatataagttaagaataaaaatacagtctgattttagcatgaacatatagttatggccagtcagcaatcaatacatagatctcatccaaacgtgatttaaaatattgtgtactactaagaatagagagagataactgttttgctagtaaaaataagaattacgcgaagtaaggtatatttgcagccctttgttttagtgtgtcaggtatcaactttcaatctattcaagcagcaattcttaacttatactgcgcatattaaacggtttgctggttaaattttgtgtgtttctgcattggagtataagctaagtgttttttctttgccatcagccgattggagtaatacaaaggttgtattggttatatgcgttgggatttctttctttttgaattcaaacggtactatctttgaatcattcaaatggagccagagagaaacaaaaataacagtgtagaggctgcgagtgagattgacgatcataataccagatctgcccccactacgaaacttaccaaagaagttttagagaagattgcttcggattctgattctgttaattttaacgcaaatagttattcaaggaaatcgaaatcagggagtccctcaaaggttggtacattagaatacgacgataacagtaccagtggattatctaaggtcacttctccagaacatccaaactcagtctctctatcggacatatacatctcatcagacgctgagaccgaaaagatggatttagaagaggacgaatcacgtgtcaaactatcggaaatggcatccaattcgattgaaagtaacggtaatgacaaaagtaaacaaaatgatgataatctttcgaagactgtaaaacaagagtacatcaataatggtgtcggtagttatattcaagaatctgcccctaaacttgctactccttcaaaagatgagggaccaatcgttcagcaagataaaccagccgaaacagaacctgaaccagtaccgtatgaagatgacgctgttgctgatacagatcatacaacagagccaaataaacttgcactaagccaaaaccaggacgaagtatctgtacctgccgaaggaggcagtcaagaagaaacaattgcaaacgatgaacaagaacagcatgctccggtagtagaggagcaggcgaatgataacgagatcaaatcgcaagaagaatcagaagtgtctttaaagcataaccgtgaagaagagcaacagtccctagagaacggctcggagcatgtcaagtctgaacaggtgttcaagaaaccgaaattacctactgagtcaaaatcaggtcactatgaagacgagcatgaaacgcatgaaaacggagatcatgatgttgatatcgacgcggatgcagaagctgaggatgatggtactctagaaagtgaggttgaggacaataatgaggatgaagaggaagaattagaacccgaaatggacgcagtagaagaagataatgatgagaaacaacagacagatacacctggcgtcgattctaccgataatggactatcgcccatggagaaggaaaggataagacaagacgctttggcagaactaacaaatattgaagtcgaatttgctcaattgcgacagagtctatatgaaaacaagctgagcaaattacagaatgagctacagatgtgtctagatggatcacatcctcaactacagacttattatcagaagattgcttcgatacgggactttaagctaaagagaatgtaccaaaggcaaaagtatgagctggagtgcatagataccgaaactagggcgacaagaacgtttattcatcaagatttctacagaaaggtctcagatttgaaacataagttattaggaaacacaacccagaagtggtatgacatcaataaagagagacgtgaaatggacgttgttgtacctgaagtaaattatcacgttccaataaaaatttcaaataaatctttgagttgtataaccggatacgcagctcctgccaatctgagacgtccaggcgacttgttatcagaagatttattatgtgaaaatatcaatttcagatatcataacaaccctgtcgataagttagaagtcattgtagacagaatgaggtttaataatgaattgagcgacttagatggtataaggaaattctatggaggattcccaggtgctcctgaacttggtggtttaaaagattctgaaattcatgaggatcttgcaggaatacagcatcaacaataggtcatataatttttcactaggtgctccaaaaaccagaaaacacgctcttatcaatagtcaataaaatgtcatcttgatgaatcatcatttaattatcgttttgttatgatgtgtaatctttacaagtataatatatgcatgactgtgtatatgtatagcacttttaacatttccacgatatgaaagtgtattcgaattgacatctgtgaattcgagaaaccttgatattttaaaatatacaaagatgtatgttatatatggaatagaagatatacttcctactaattaaacatttgttggacgttggtagagataaaagcgtaaataataaaaagatgagaaagaaaccccaaaaatagtagtccttgtgaagtgaggaaaggttgtgatgaattggtcagattccaatgtgaagcgaaatatctttattttattaagacaccaggatagaaataaaacttataataaaccgtatccaacccgatgatatttttctataagaaacaaagggatcgatatcatgatttgatgtccaaattaaaagggcatttgaggatgacaactggatcaatttttaagttttctggaataattctgcgtatatcattgatataatcgcagatttaaaattcggtaccacatgataatacgagggaatctggatactatatcaatgcccaaaacttcttaagtgtccgaacttcaaaaaaaaaacagagaagcgtattttgtcaaggggaaattttttcttggagttcttgcaatagttcttatcaataaagtagtttatctcaatgggatgaaacgagaggtggtggcaccagctctaccatgtctaactggagtgtaggtgatagagaattcacccaagtagtgaccgaccatttcaggtctgatttcgacttggttgaagaccttaccgttgtaaacaccaacaacagaaccaatcatttctggaacgatgatcatgtttctcaagtgagttctgacaacagctggcttttcattttctggagcagacaatttagcagctctcaacttcttcatcaaaccagctggcttttcagacaaaccacgagcgaactttcttctaactctggctggggccaacttaacgaagtcttcagttggcatttccaacaacttttctaggtcaacacccttgtaagagtaggtcttgaaggatctctttcttggagcagcggcttcagacatgttggcttgctttcttattgtatggttcggtgagttaagctaaacaacaaaaaggaaaaggaaaattaaaccaagctctattgaaaccttctattataaaaagaatacgtgaaatgaattgcaatatcaactaaaatctctatgtgaaatcaacaaaagctgtaactatcaaaaaaagcattaaattcaaactgagattgttcgtattggtgaaaaaggtcgatatcctcaaacttcgcaatgattctgaaaagttcaccaaaaaaatcattcaatggtaggacccatactagggaaccaagctgttcgcagagacaatagcggaggagaagatgggccctattcccagctggaagcatgggttggacgggggagacggtaaggttaggcaggaagctttgctaccggtaggcaggccagtaagcttgcactccgtgtacccaacagggtggagaacagggagggagtggaaccggagcgtaggaggaaattggcgagtctgcctacagattgtaagttcggtgcgaaaaaattagtaagtggtgagactcaaaatgaaaataagggactgttaccacaatacaccacatataaaaatgcgtttaaatcctattactatatgtacaccgcactttgttgttttcttaccatccatatcttttaagtttttcgtccgaaaaaggaaaacatctaggcgaccaattccactgattttctttagcactggaaaatcgaggaatctggttcccaatctgcaattcgatggaatcagtgcgagagttagtactctcacagtggaaagcttcaacgctttccaatggcgcccggtaattctctctaccttgacgaatcttcaacatttttgtcaattgattagaggtttacaatacacgtttaaggtttaagtgcctttatattttaattgttaaaggcataatactgtttaattcttggtatagttcacgtaattctccccagaaacctcgacaaatattgaacgcttaaagatgaagtacttggccgcttacttgttattaaacgccgctggcaacaccccatcctctgacaatgtcaaggctgttttagaatccgttggaatcgaagttgaagaagaaaaggtttcttctttgttgtccgctttggaaggtaagtctgttgaagaacttatcgctgaaggtaccgaaaagttggcctctgtcccagcttcttctggtgctgctgcctctggtgctgctgcttccggtgcttccgaagctgctgctgaagaagctccagaatccgaaaaggaagaatctgatgacgacatgggtttcggtctattcgattaaacaaatcaattttaaagggacttacacaataatgaacaagaacttttgatatcctgaaatttttgcaaggctaaaccagcaataactttcacataatggatgttatggttgttctaatttttctatctattcttttattattctacgtttaacgtttcaaacctcatacaaaccgttcctcacacacgctcagcatttgcattcaacgggaacagaataaatcaaaaggtgggaattctttgcatttttttgtaaggatacctatgtactatccattgcccattatcaatgcttactattcatgtacaactacatcaaaccagtatacaggatctatatctgataataataaaaacattactactcagtgattttactcaaaatataatcggcgctgtcctactgtctgtaatggctgacaatatacaattgagttgtaaatataacaatcacgtgacatcaatcacgtgatgtttatttatttattttttctagttattccgcctcttgccgagatgacaaatttctattcaactgtggctctactatgtcttctggagctcatttcttttccatgaaaatatgtggcgctttgttgatgatatcgcatgttcacgtgcaattgtacagacacacaggcagctctagtgacagacagggaggcaacttacagaaatggatccaaaggccaagggaattcgattccaattgcggatttggtaaggctgctttggctgcttcgttttgggtctcgaatgacaaacgaatttttcccactgagttctctcatttctttcctgcatttgagctcgcatctgcaagaactggaacttctggaggcacagttgatttataatgctcgagggttcttcttactcatttgatatatataagaaaacttaattctaattaaacgttacctattaattatactgattctgtctatttaaaccctttcttagttttaatcatagctaatcatcgcaggtagaattttagttgtatctggttctaagttccacaagaaagtgaaaataagatatatttgaaatgggtttgttaccaactgataagtttgctacaaaggctattcacgccggtactcacgtggatgttcacggttctgtcattgaaccaatttctttgtctactactttcaagcagtctgctccagctcaaccaattggtgaatacgaatactctagatctcaaaatccaaatagaaagaatttggaagatgccattgctgctttggaaaatggtaaatacggtttagcgttctctagtggttccgccaccactgctgtgattctacaatccttgccacaaggttctcatgcagtttctattggtgatgtttacggtggtactcacagatacttcaccaaagttgccaatgctcatggtgttgaaaccactttcaccaacaacttggtagctgagttgccatctttgatcaaggaaaacactaaattggtttggattgaaaccccaactaacccaactttaaaagttactgatatcgaattagtagccaagaccgctaagtccattaataaggatatcctactggttgttgacaacactttcctatctccatatttgtctaaccctctgaacttcggtgctgacatcgtcgtccactctgctactaaatacattaacggtcactctgacgtcgtcttgggtgtcttagctaccaacgacaaagtcatctacgaaaagttgcaatttttgcaaaacgctattggtgccattccatcaccatttgattcttggttggtacaccgtggtgtcaagactttgcacttgagagttagacaagcttctttgtccgctcacaagattgctgaattcttatcctctaacgaaaatgtcatcgcagttaattacccaggtttaccaactcacgaaagttatgcagtcgttaagaaacaacaccgcgatgctctaggtggtggtatgatctccttcagaatcaaaggtggtgcagaagctgcttctaccttctcatcttctaccagattattcactctggctgaatctcttggtggtatcgaatccctattggaagttcctgccgtcatgacccacggtggtatcccaaaggagcaaagagaagcatccggtgtttacgacgatttggtcagattatccattggtattgaggatacagatgatctattggaagatattaagcaagctcttgcatccgcatccaactaatattaattttcgataaaacaccagaaacacccttccacatcaatgaagaaaacgagagcacgttaattaattcatatgcgacagcattttcaatggcagggttttcaacccccatctatttgctttaataggtccacttctgttattgtacggattagtatatagaatttttttttatctatctggctatactagctcacgtctttgatagactctttatctataataacccagaatcactgttttgatagaacattcacttctcactgacggcaggtagtagccttcaaaatccaaaccaatctgtcacttctttctttccaaccttgaagtttagatgtgctgtcatattctgttcatgccgtgaaagatctaaaaataataaatgacaaaccgtgtcttgccatttcacgcacacataacagctatagtatcgttagagtggattatcctctaccggattcataggttcacacaaaaccacactatctagatagaccatcaggtttcgatatgagagtcaaatgtgtaaacagagccatatatgtgctgacggtgctacttttttctaggctggttgtttctcaagttgtcctaacaccatctaattcaaatgctgatccgaaacaaaaagatacagcaaatacagttgctgcagtggaagctaataatgacgctaacatagctaagaaagacgctgaatcagatctagttattggagatcatttggtctgcaatacaaaagaatgttatcccataggatttgtaccctctacagaatggaaagaaatcagacctggtcaacgactacctccaggacttgatattagagtaagcctagagaaaggtgttagggaagctaaattacctgaaccaggatccgagaacattggtaatgaggaggaagatgtgaagggtttggtacttggtgcagaaggttcgaccttatctgaatctgaattgaaagaaacctcagaggatttggaaaatgagcagagtggattcaaattgaacaatgctgaaaaagagagcgatattctacagcaagaaactgatcttaagatagcggtgtcggataacgctgaagcaacctctaatgaacctgcggggcacgaattttctgaagattttgccaaaataaaatccttaatgcagtcaccagatgagaagacgtgggaagaagttgagactcttcttgatgacttagttgagtttgcacatgattataaaaaaggtttcaagattttgtcaaatgagttcgaattattagaatatctttctttcaacgatactctttctattcaaattagagagctggctgctaggataatcgtcagttcgttaaggaataatccaccaagtattgatttcgtgaatgaaaaatatccacagaccacctttaaattgtgcgagcatctttctgaacttcaagcttctcagggctcaaaattacttatcaagaggtttttatctatacttgacgtgttgctgagccgcacagaatatgtgtccataaaagatgacgttttatggcgcttataccaaattgaagacccatcttctaagatcaagatattagaaatcattgccaaattttataatgagaaaaacgaacaagtcattgacactgtgcaacaagacatgaagacagtgcaaaaatgggtgaatgaattaacaacaataatacaaacaccagaactagatgaacttcatctcagatccttcttccattgcatcagtttcataaagacacgtttcaaaaaccgtgtcaaaatagattctgatttcttgaattggttaatcgatgagattgaagtgcgcaatgaaaaatcgaaagatgatatttataaaagagatgtggatcaactggaatttgataatcagttagccaaaagcagacatgcagttttcggtaacccaaatgctgccagactaaaagagagactctttgacgatgatgacactttaatagccgatgagctatgagtgattgacagcgaaatacataaattggcattacgttattagatagaatttaaattggaaaagtctatgtaatttatttaaataacggtagtctcagtcctttgtaacctcatccaagaaagttgcatcgttttgcaaccttactctgaacttttcccaccatgtatcaaaccttttgatggagacgttcccttgagcatcgacaaatccagttaaataattataagcatgctgaacgatcttcgcagccaattcttgtgttaccacaggatattgtttcgcaagagctcctgcagttaggatttgtacagaattcttagatagtaccattgcaccggcaccagcgctcgaactcaatgcagcttgctccgctttccactgctcaagcttggcagtggcatcatttcttggttcaatggaaattcctatgattaactgcgaaatattgtgatttgcgttggcaccattgaggtcatctgtcattacatcgtcttccatatcaatttcacctaatccatctgaagggttagctgtcacaccattcccaacattggcctgtggaagttttaccttaaaaattgcactcggtttctcattacccaagtatccaaataatttgaagtcctccgctggatttagtttaaaatacactgtcgcaaggaattcctgagggaatgttacgtttggtagtataaacaaagtgatatgtgagtatgattttggctttgttgatgataatactattgtatgctgcaaaccattagaattaggtacttcagtggataattgtaaggggttcccggaggcgatggcagcaaacattttacaattcctgtttgctgtactttgtcagagtgtgagtagataggagtaccattttcttggaacagaaagccgtcctacaaaggttgtgtgtgttttcccaacttcttttatgtatgtatcctttatattacttgaactttatatcattttcttgcttattcgagaaatttcctaaccttcacgcacatgaaccccgagagatagaaaattgctatatacatgaatagtaactatttaatatgtagtatttatattaacgcgatttgatcagcgttaatgcgttaccaattcttctgttagattcatctggtgtaagaatcttcaccaagacgggaagtttaacgcaaggcattgagccgacaagagcaaatctaacactttcgaaaataagtttctttggtacggataattcttccactgcagttttgatgaggtctgagatgttagattctgagattttatctttcaggaatgatagtaccctgcaaacatcatctgtgttatgattctccaagaaattggtagcattctcattgacataagtaggatctttgaataaattgtaaaaagatgaatcaatatcgtaaatcgttgtcaaatgggttccaatagactttaaaacctctcttaaatgatctttgctcaatgacttgtaattgggtttcataaaatcgtatgcgatgtctaaaagctcttcgaattggtccggattttgtagcctctgtgttagatagtgcttattaaagtagtataattttttgtcatccactttggcatttcccttcgtcaagtgatttaaatcaaaaatatgcactaattcctcgagactaaagcattcgtggttagctgaagccaattctcttggaggtgcccacccaaaaagtgcgctaaaattgatcaaagcttcaggtaaaatgcccttcgcacgcatcgcccggacatcagcatcacctttacgtttacttaattttttatcactggtagttgtcaacaatgggatatgtacatagtgtggtggtgtccaaccatacgcttcgtatagggcagtgtgttttggtgtggacggaagccactcttcacctctaataacatgtgtaattttcatcaaatgatcgtctataacatttgcaaagtgataagttggcaagttgtccgatttcatgaggattggatcatcgtatctgatatccaaaggatttacttgtggttgtatgtccaatttgccatgaagaagatcctcgaatggtggatatttgtctggagatttaaatctcacagtaaaaggaatacctgcctttaaatttgcttctacttcttgatcggatagttttgaacagtgacgatcgtaactcactgtagttggtggttgtaatttctgtgcagactctcttaatgcatcaagacgctcttttgaacaaaaacatttgtaagcatctcctttttccacaagagtattaatatattcctgatatattttggttctatcactttgtctgtagggaccatatatttcattaacgccaggaccttcatcatatttgatattacaccattttaaagcatcgtataaactttgttctgcaccaggtacaagtcttttctgatcagtatcctctaatcgcaataggaattcaccacctgtattcttagctagtagataattataaagcgcggttcttaatgaacccatgtgaagaaacccagttggagaaggagcaaacctggtccttaccgggtacttaggatgcacatctttgacaggttttttaacaaaaagagatttcttggatttattcagtataccttcaagttttccttttgacaaagacgaatattttctagtgcatttttcaatgctgcccaacactgaagctctgaacatcgctcgaggatttgcagctattgtcaaagtccactaatgttgtactctcacagcgttagttgagattacttcttttcttgatatgtgaaaaatatataaatcaaggcagtttagacggatgtcagaatcatggttgataattaaacagagacaaagaaagagagtgtgtatcaatgaatggtaattttcgtttactatatatctataatgtagaacgatgttgtttataaaatatatgacgtagtttctccgaaatgagttctttgtggatcggttgcagggtctggtatccaagatcccgcgaagacgcaatgaattctcatcctctcatgataaaagagattcgtcaaaagctttggtgtaataaggaagtattgggaagtattctcagcacaggcattttctaccataattctgtgaacgattctttcgttggtttgatccataccttgattaatctcgtcgactactctgaatggagacgaggtaaactgctgtaatgcaatcatgtaaagaactgtagacacagccctttctccacccgattgtacatgaggattaagctgttgtagttcactgttatcccgaaacttgacttttatttcaatgcaccaatcgttgaaagagtcaggtttcttcaactccacttgaccggcgctcccaacatatgcgaaaagatgggagaatttcttagagatctgtttcacaatatcatccaacctaggctctagggagtttcttatttcaagtattgtttgagcattagatgcgagcttggctcgtagatgaggaagagttttctccagtatagatatatcttcgttggttttttttagaatgtcaatgacagaagtgtcgttgttgatcatagagagttcacttgaaagcctatttataatactttcgatatgaatcgagctgaattgattttcttgattatattttaccgcaatttcgttgagaacatccttttcctcttctgggaagttctcgattgcattcgagcactttataaactcatctgtgtttttgatacttttgtattgctcagaaacatcgatgaactcttcttttttcaaattgcgcgcttcttccatagacctgcacacctgtgatatggaatcaattttcgtacgtaattccaggagatacatattctttgtcgccatctcgatatcaaattcttgcatctgtatggttatggggtgtaaacgaagtaaagctttcctctcgctctcgcgtgcctcttgtaacttgttactggcttcttttatgctgtctcttatatctactcttagcttttcattgttgtcgttgactttctggcgatatctactgatcttgacatcatattgctgcaagagtcgagaacttttcccaagctcatagcgctgagttttcaaatgatctgttacgtggcgtgattctactatctctttttctttcttagctatgtcagtggacaaactttttagattttcatcaagcttgactacctcctcatgcaatttcttaattgataaattgatggcatcaatatcggaacgccccattgaagatgctttgtagaaatcagcatgcattttgatacgaacagatttagaataaatttgctttctaccgtactcagactgatttatattatggatgtaagagccttctatgaattttgggaaaagaatccttccgtttctgtcaacttttttcaatgcttctaaatgacttttgccaagaggtcgtctggtaacgggtatcatgtggattttttgttgctgacagagcatttttatgacattttcatctcctttgatgaaatcgactaaatatccttcgaatccaaatcctcgtagttcttctcttgtcattcttggttttacaggctgatcagatagctctcttatattcacgttgaacttctcaacaaggtaatcactaaacttcgcataagcatgtttatctatcatggtaagagcagtgctagtgtgaaagtcaatgcaagattgtaaataagctgcgaatgtttcgtccacggctgataccgatagcaaagctggttcaaataccctccctttagcatccttcacagatcgtaaatagagaatggcattctttagttttgagaaaacggtgctattattttttttttgtaatccatcgagtatgttgagattgtcgttgcttgaaaggtcgttttgcttcttccgcatgtccgcttcttttgcttgcctaatgaatagtattttagcttttttctccttcaaatctgctatgtcatcgtttaactttaatcttttcgcagaagcagtactcaaattctcgtctacttcatgaatcttttctggatctggtaaaacaactttgtttctctcttcttccagtgctttaatcttctcttcgtttacctttatatcctccttcaaagacttatttctggttgtaaggaaattcactttagattcgcattccgacaaatatttggaggttttttgaatgttttctgtgctactgttgaaactcgttttagcggaatatcgccttctactcaaatcatctatgtcacttttacaattattttcgtctgcagtcaatcgaactcccaataaattaaatggcttcgattcattttccatcgtcttcacttcattcctcaaagcattacgtttatccttgagaccacggattttctccttatgttctttaaggtacgtgtagtttagtaacttctgatgaatatctaattcacgtgccttctcttcatagagttcgagcgcatgagcctggctttcaagagctgcccttgaagaagtcaattctttcaatttgttttctttggcccccaaatcgatttgtagttcatttccttcagcttgtaatgatttcagttcagaaagtttctcgagaagtcctgcttctatcgatcgaattgtttcatttagtagcgtatcaggtttcaacctagcaaactcttcgacacgctcctgtgaaaggaattgacaaaggttatcaagctggatatttaatactcgtaccatactttttacaacttcctctgttaccaccttgttgttaatgtagtatttggatttcttcttttccatactcaaaactctttttacatggacaacgtcatcatcagtattgatcatgttaaagtcagaatgtaaaagagcacttgagttctttagagttatttcgatcacaccttcatctgtcccatttttaatatattcttctactttcttggatcttccgatatactcaggtttacctgctaaacctaagcaaatagcacatacaaaagtggatttacctgaaccattgggaccaataatcatattcaacgatggtgacaaatggaactctgttaatgcatacgtaacgaagtttgttagtttcagttttacgacagctcctggttgaaattcattcaattccgaatgttgaatccttaatctctttgttgacaaattcttcgagttatttgtacaaggattaatgtcatcgttaagaagggaatctgcagtatcatctacgtaatccccgaaattaattactgatgtcattgctgattgagaaggggccattcataagcaaccccagcacattctactggtatctttccacgaactccttcgtgttgcaattcacgtaatgaatactaattgtaaaatcgatctgtttttcttttaagtatttcataacattttgactaaaagaataaagacatctctttctacaaacactttaacgtgtggaatattaatgtaccgtcatctagagaaaagcattagcaaaaggttgtaaaattatattactgctgcaggtgctttgtacattgctagtgataatgtccaagaaacgtggtagaagacatacagccaaggaggacagtaatagcgattatgaaactgatacatatggtttggcagatggggatgataaatcgcggccatattacctcgtagaagaccttccctgctctctagagcccccacgttacgataccttcacgtatccactatctgtgaaagattctgctgtactttacagttctttgttaagtagtaggaggacttgggtcaaaggtgaaatgtttcaattatattgggcgaagcagtatatgaacactaaagagaaggaagaattgaagaaagagggtatagatcctgactctatcgaccagtctgcagcaagagaaaaaatgaataagctatgcgattgcatgatgcaaggcggaccgcatcagtttccaatacggttgttcatcttgaagaacgatgaagttgaaagggcatggaatgaagctaaggaagcaaagaagagagatagggaagtacgaaagaagcaacaggaggaggagaaacggctaaagaaagagcgtaaactcctgagaaaaaaactgaaacaagaggcgttagagaaagagaaagagaaaaataaagataaggtcaagaagccgagaaagccttacaagaaaagtgcaaagagacttgaagctgagaggttaaagaaagaggaaaaggctaaagcagctgctaatacttcaggagttaaaaaaaaaataagtaaaactagtaatgtcaagaagaagaaaatgaaagctgtcgtaaggcctaaaccatacgaagaacaagtaatgattttaaatttgaataagatggctagaaacgacaagcaattgaacgatttgatgattaaagtagcaggtggtcaggcaagtctggctgaaataactcagttcaagaaatatattgaaaaggcaaaggctatgcctcctcccagtggaacttggaagccaatgcttgaagaagttgaagtgactgatgatggggaatctgatgaagatgtaaaagagcttgaagtgacagaaaaaagtgaagatgtaacaccaactgaagttgctttaccaaaggctgcagttgctgctaaagaagttaaagatgttgtggtaactccaaaccttccccctggcaccgaaaattctggaaatggtaaaccgccctcattagacgaatccaacgctcaagaatcaacggatgtgaacaaaaaccagccaatacagaggcttaacatatctaaaaatgttcaaagtgtgaaaaacgacattactgagaatacagacttggcttccaatgagcatatgaacgaaaagcaggtccagaaaactcctgaaagtacaacagaacataaacctgacgaaaaaccaaaggacgctgctatgagcaagagtaatgaaaaaaaacctgatgaagatacggcacaggacacctctaaagatgatgaaaataaatcggataaaagcgacagcgacagtgacagtgatagtgacagtgataacgatagttctagtagtgatgaaagtgataatgaagacaatacaagtcaaacaaagaacagcatagataatactgatgatggagtaacttcagagaaagcagatactaatacagatgtatcaagtgataaacctcctgatgacatcaaatccgaaggagaggtcgctgctcctcgcgtaaaaagaaagtataggagacgttctaaagttaaaacagaagaggaggaagaggaggaaaaggcaatgcagttgacaacattccagcagaagtattcgaatggtgctgatatggtttttgaatatgttgaaaatgccaatgttcgtttccttctaccaaaatattcaatcttggaacaattggaaggtgaagaaagctatcttttatcctttattgtggttcataataggcgagaagttgcactttttacgactcgcaaactaaaagagcttaacaagaaaaagaacaaagaagatcatatcaaacctgaagactataacccatttgaggatgctagatgtcccgatccattattttcatctattacactcaaactaactggaattccaaagaaattttccaatatcattctaaatagtttccatcctcaggaaagagtgcagctctatatgaaatctatcatcgaccgaggcagtaggctcagcggatacaacctctggtaccaacttgacgcatatgatgataaagaattggctgaacggctaagagtaggtttaaaagaatatgaacagacctttaagagtaaaagacaaaagaagcaaatcttgtgaaagcaagccttctttttatgtattttataaataatgcattatatgttttcatgaagtttacgctgaatactgtaactgtatgccgaacttagatgggctaatcaatgaccagttttgatgttccaatgaatcaaggccgttagtggagatttcaggaggttgtgtgagttctgccccagcagatattaaaaatcccctgatttttccttcccacaataagcgcaaattcatgtcacgtaaagatgtgctgactttgaatacctgtgtgaagtttgcttcgctatatctctcattgaaattctcgatgacgttacgttctttgtttatcttttgcagtgaagactggaaagttagattcaaatctttcaacagtctctgggaagaagcaccggaattttccgttcgcgtcaatagatggtaatacattggagtcttgtcatgcgataattggggccaatcctcaattgtttcaacaggttctgatggtctttctacaggaattgatgatgaatttttccacagttccattcctagtgttaaatttgactgtatagaatagatgttgaaatcatatttggtacaaaatgtaaggttttcatgagtcttgattgaataggtagaagaaacatgaccgtataatggattcagagacaaggtgaaaatcaatggtttcccggtgttagtagcatgagaacaatatcttaaagtagttgagcatccagggctcaggttcaataatgcacaccatatttcggatccaatggaaaggcttgaattgttgtatagtgaaaggtttgatttagaaccagctgaaacaaaattatgcacaaacctgtaacctagcaaagcttcattggtagaaaatatgagttcttgacaatttatcccagtgtttttctgcaaatacatagtcaagatgctcgatccgctcttggaacttgaacatttcaaaatgaactggtagtaatttggaaaccgcctgatgtacattgcctccaacgagctagaaggataaaacattcgcccatacgctaaagaaatcggtaattccggcactttcggtacttctaacttggaattatttttataatgatggtagtagggctcaatgtaccggaaactttgagtcatttgctgcaaatgcactgatgaagatccctcgataaactgatctaagttctcacaattggtgtataaatatgttaaagagccattgattgtcttattgttagttagctctaacgtattgtaagaataaggtgtggccctgttacttacttgaaccttcaaggcagtcggaatgtcaaactgtagaatattccgactagttcctactatgttctcataactgttatctttattccatgacgtgcattcttcaaactgccgtagcacataatccatatattccaacatatatctaccgaactctggcgtcccgtaagaattgttactacaaagtatcgcctagtttcctgaatccaatgttgatataaagttgacatattttaaaggtttcgatattcaacattttttagttttttttgatattgagtttaacgatcatatgtatttaactattttcacatttcatgcatgcagtaacattggcaattaaagataaaagtaattgagaagtgagaggtttgtttgatctgccaattagtatatcgttgcatttctgtgccctgtgtgaagcttactttcggaataactttctttttgaacgttgaatcttctcctaaagagactgttttatttttcaattgaagcatttagcaatcatattaatgattcttgagtgaaccatttgcgagtaacgtatcagaattggcttatcgaactactcattacgacaattataaagctcgtagcgtctgatatttcatactgtaagaatcatgggagatggtgatgatgattcagttccagaattaaaactttctctgacatctaccccggtacatacaacaacgtcatatggcgggtcgttatcatctgaatacacagactccccatggggtaaaagggggcacatatcttttagtggtacgccgacaactaaccggagaaggaggtcgagcagtcgagcgtcgagcaaaaatgtgaaaagcagtgaaatatctccaatatcgatgatatttcgcaatttactaattctggaggacgatttaagacaccaatcaaaggagcaaagaatgcttaaatggcaattcactttgtttcttgcgggcttagctggcattgctgcgttttccttttacgaattgtatttttccaatgatcaggttaccggtttatatagaatagggttgcaattcctattgatattcatttcagtgacaatagtattgtttcatcttagcggtgaatacaaaagaaccatggtaataccaagacggtttttagtcaacgcaaataaagggatgagacaattcaacgtaaaattagtgaaggtgaagagtacatggttacaaaactatgcggatacaatacgtattatcattcgtcgagtatcaaaatggaatatgaagcttttgatcacgatgggagctacaaacacctcgatatatgcattttggtcatcgctttctatacgatgtctgcccagacttggagctgtggatgttaagttagtgctcaatgcaaaagcatttagtgctgagattcgagaaggttgggagatatatagagatgaattttggaagcgtgaaacggtcagaagacgtaagcaagagtctcaaaacaatacgcatctgaaaagagactaatgtttgagagtagcagttccgtgccatatatactgtatacctatttctacaacatagtaatgttaatataataatgatttcaaaaggactcaaaagaaacttatcagagtagcggttctgaataaaggattttatcgttcattaaagataacaattcagcaaatgtgcaaaagaataactcatcatcaagaatccaagccttatagtaatatcattctatttgttgttttttaattcaagagattgatatccattatactaattgcttgacgcctgtcaaagcaagaaaacatcattgcgagtaacatcttagtataatgaatagcgatatcttctacctccaaagccatatctgaccgttggacggctgttgggcagccgttagtgctaatcccaccccactggcgattgctcagatttgaagcaacaagttatctaattgggatgaaaccacagaacgtggaatttttcacttgcaatgctaagattcgcttcattttctgtccgggtaacgtttgatatcgtatgttagggtttggggactgaaggcttggcagaaattcaccatgatagagatactaaatggcaatttgtgaggaccttgagcatcactctccttatccatttatcttatgggttgacagctgattcataatctaagtgttgcaggcccctataccagatttaatcgtattcataatcttagtagtgatataaacgaagtaaagcagcataaaaacattattcgatcacgtgattaagtacttggatggatttttccttcagatttttgaaagtgtgatcccaattgtgccttaccctgactgcccctttccgattttcactcaaaaccaaaataacaacagaaaaggtttaaattcaaatagaaacaatcatagtgtgatatatggatttattaggatttgtttttacaactgctgtctttactgtacggaaagtgaatttacgcgcaagatcgttaatttcaaacatttttatcaattgctgataaaataccggttttgtttcctgtttgtcggataataaacactttagacggtattttgttttttcggtgattgcataaacaggtcataattattactattaatttactattaatatatttatcttatcagatcacagatcatagatcatagagagagatacatttggaaagagaatagttctcaattagttgagaaggaattgaatcaagaaaaaaacgtgttgagctctattcgaccggtctgcttgtgctatattttccaattttggattagtcctgtcaaatcccaataagaaatctttatcctgattaaggtgtttagcaacgcagaggtaaaaagaaaactagcaacgaaagtgtctgtttgatacaatacttacacacggcaagatgatgcgtggattcaagcaaaagttgataaagaagactacgggaagtacgtcttctagttctaatcaaaaacggaaggataaggaaaaggaagaaaaaaaagagaaggaacactcaaagcgatctcccagtacttcgggtagttcttctgcaagatcatcactagataagactagccatagatctggaagtaccggatcgaatgccggtagctctagaagagtagattcgaagtcgggtagcaataaccataataatcatggtagcagtaatagtaacgccagcggaagcggtagttctgcgaacaataatcagaatgatggtgtgccaaggactccatccgttaacataacgaaagcagattccaatgcagttggtaaacctactttaataggagctgcagctcaagtaacaccgcctcctacaagcccaaaagctcagccggcttctttgaatactccatccagtgctaccggtagtactacagtattgaaggattctcagcgttcgccaacttccatagaaatacccagatcgtctcattcttttgaaaggttaccaaccccgactaaactcaatgcagacagcgaccttgaaatgataaaaacccctcagcgtcactcttcttctagatttgaaccatctcgttatacccaaatcgtaaaattaccaaggttcgaggaggtcctgccagaagaacaaattccgttattcattactaaggtcgaccaatgtaacacaatgtttgacttcaatgatcctagtttcgatattcaaggtaaggaaattaagagggtaactttacaggagttgatcgaattcattgttacaaacagattcacttatactgaagagatgtatgagcatgtggtgaacatgttcaagattaatcttttcagacctattcctcctcaagtaaatccagtaggtgatgttttcgatccagatgaagatgaaccggttaatgagctagcatggccccacatgcaatatgtttatgaattctttttaagatttgttgaatcaccagatttcaatcatcagatcgcaaaacaatacatcgatcaaaacttcattttgaagttgttggagctattttccagtgaagacatcagagaaagagattgtttgaaaaccactttgcatagaatatatgggaaatttttgtccctcagatcgtttataagaagatcgatcaacaatattttccttcaattcacatacgaaactgaacgattcaatggtatcgcagaattattggaaattatgggttccatcatcaacggtttcgcattacctttgaaggaggaacataaagttttccttgtcagagtattaataccactacacaaggtaaggtgtctttctttataccatccgcaacttgcatactgtattgtgcaatttttggaaaaggagcctctgcttacggaagaagttatcatgggattactacgttattggcctaagatcaactctactaaggaaattatgtttttaaatgagattgaagatatctttgaagtaattgagcctctggaatttatcaaggtagaggtgccattgttcgttcaattagcaaagtgtatttcttcgccgcatttccaagtagcagagaaagtgctaagctattggaacaacgaatacttcttaaacctctgtattgaaaatgcggaagtgatacttcctataattttcccgcccctatacaaactaacctcacaactggacaagaatgatccgttgagtttagaggatggtgataatggtgaagatccgtacttaatggtcgagcaagccataaattccggctcatggaatcgtgccattcatgcaatggctttcaaagcattgaaaattttccttgaaacgaacaatgtcttatacgaaaattgcaacgcactttacatatctagtttgaaagaaaacaacagacgtcaaaaagagagggaaatgaactggaaacaattagaggattacgtttcgaagttgaagatcgcagaaagttgaaaaaaagtgaccactatcatccttacggactcaccatcaccaaatcattattatcgtcttcattatcatcatcatcacggtaaaagttatgtatatacttatatctacgcgtctttttcaccgaacatagaattgtttccgtatatatcagtaaacgacaaatgatttccaacccaaataggaggccttaatttacatataaaatagtaataaaggtactacttgactgataacttgccgcttatcactttctaactgacaattctatatattcttttttataatgactgtcacccaaatcctattcttttcagcatgttgggttttgtatgattcttaaatttcaacatcggttgaaaaaaaagggtcgcaggctccatcgtcagtatggctatataaagaaatattgagaagtacgtgcaaattgctattgagttaagaaaacgacaattcgtagacaaaatcactgtttataatttaatctttcgataacgaagaaattcggttagaaatcagtctcatttagttcaactcagaattgtgttttatatcctcgagtgaagacagaccaatcgacataataggtaaagaattaggaaagatgttcagaacagcagcaagaaaccttggcgtgccattaagaagaagtgtttatgttggattcagcggtagtttattagtcggtggtggatcgttgttgcactcgatgcaaccaagctcatatatcatgaacgattcaattgttgatgttaagcaaagaacgaatctaccacaagagcttggattgccaagccgtgttgatataagttcgaagcaaagaagagtcaactacagacaaatgtgctacgggtcaattttaggtctagtgttcggtgttatctttggtaagatatcaagtcttctcgtgttcatcaccggggttggattcgttgggttacaattcttgcagaacaggggagttatcagcagtgacagcactcgttctctttccaaatacgttgtgaccatcggccgtgagaggattgatttgaacacattgatctgggacaaacccagcttcaaagtctcattcatcttgacatttgtgctagctgcacttaacgtctgattggttccgagaacgctaccttattcagttcacgtgactttttctcatgtgaaaacccagaatatcctataacgttatatttaagaattagtaaaataattattgtgtgtaactcgcttgtaacatgattaattaccaatcatcaaagacattttcataaacgactggtaggctacattagactgggttgtcaaggagataagggagtttaaactaatgagtatagttcatccagatacctcgaagtacgagtttaatttcgagccatttctacggaaagaatattcgttctcgttagatccagatagaccggtatgccaatactataattcaagagaggggataaaatcctgtcccaacggagcacgctgtccaaacaagcatgtgctaccgatatttcagaacaagattgtttgtaagcactggctccgaggtctctgcaagaagaacgatcaatgtgaatatttacacgagtataacctaagaaagatgcccgagtgtgtattcttcaccaagaacgggtactgtacacaatcaccggagtgtcaatacttgcacgtagatcacaagagtcagttagaagaatgtgaggattataatatggggttctgtccatcgggacctgcatgcacgaagaaacatgtcaaaaaggtactttgccccagatacttggtagggttttgtccactgggtaaagattgcgactggtcgcatcccaaattcaaagtaccttcagaacacagcaaactgcgcatcaagaaagacgagcatattaatacaagaaagatggatgaggaaagggaaagacgcttgaatgccattatcaacggtgacatcctagtcacgtgactgaattttttcagttttcatcagtgcgttcgttctcagccactgctgctgtcactattcactattcagctcaccatacgtaattcgatacagatacagatactaagtaacataatactacacaatgttacagccggataattctatcaaccgacagcaaaagcaacacacctgaaaaattaagggaaccaaggctcacataccttaaattgcttatccaataggtatcagacctctcagccaaaatcattcgctgagtttcatttatggacacgcggtcgacatattccccagtatagaacactccattccacagtttctttcggtttcttttttttcttgcaatactgataagcattaaccctgagagcggacgcatgaatgtacaccaggcaacagcgtgagttcttgaagtcagttttctaatacacctataactggcactagccagctactgggatggcagtctcgcatcacagcaaggctgtcgaccggtacctcttcgtcacttcgtctctcctctgctgctgtctatgaaccagcgaggttttgctcaaaatggaaaatgaaattttcgacgaaaacaaacagaaataaaaaaaagggaaaagggtaaaaaggaaaattaatggaagcaaggtttttccaaagcaacttccggccacttttaggagaattgccattgcatttggtaatttatttgtatatatatataacacttctatatttaaaagtaaggttactattgtgataataacacgcaagctattaatattgaacatacgctcagttatatagagttcatttgatcgagtaatagttaaaaaaaaagataaagacaccatatattacaaccatgcacagaacatattctttgaggactaccagggcaccaactgcctctgatttacagaatccaccaccaccaccatcttctaccaagagcagatttttcggtaagggtggtttagcttacagtttcagaagaaacgcagctggtgcgtttggtcctgaactttcacgtaagttgtctcaattagtgaagattgagaaaaacgtgttgcgttctattgaattggctgctaacgaacgtagagatgctgctaagcaattgtcgttgtggggtttggaaaatgacgatgacgtttctgatatcaccgataagttgggtgttttgatttacgaaatgtctgaattggatgaccagttcatcgatcgttacgatcaatacagattgactttgaagtctgttagagacattgaagggtctgttcaaccatctcgtgaaagaagagctaagatcgctgataagattgcctacttgaagtacaaggacccacaatctccaaagattgaagtcttggagcaagaattggtccgtgctgaagctgaatctcttgttgctgaagctcaattgtctaacatcacgagatcaaaattaagagctgctttcaactaccaattcgattccgtcattgaacattctgaaaaattggccttgatcgcaggttacggtaaggctcttttggaattgttggatgatgctccagttactccaggtgagactagaccagcttacgacggttacgaagcgtctaaacaaatcattatcgatgctgagagtgccttaaaccaatggactttggactctgctgttgttaagccatccttgtccatcagaaacttcgatgatgcttacttggatgaagaagaccaagaacaatggaatgacgaagaagctgaagccgaagctcaagaagaacacccagttgctgcttaaacttctcactcttctactccttaggtgcttctaaaaatctcttttgtcacaaatttattatactcttattcgcccctattcgttttgtttcgattcttttcaatgagtagcccactggctggcaagcaatttttttctctattcgactaaccttacctgctttaatataagtgccaactactatctcttaattgtcgttttaataaaatacaagtattaactctttaaaaagagaattttaggggaagggacttttcccaaaaggttttatgccatgagaatataggaagacaggtgggaaattcaatttcctattccttttgcatctttttctttgtgaatgactatgccttacactacgaaatggctgtcttctgatcatgaattactttggtctgttctttgaatgtctccatcgcataatcttgaaattattggacggaaatactgttgaaaagattcagaaactggaaacgaaaagcaaagcgaaagacacttacaaagaaaaaatgtttttaatatatatataatattgatttaaggattgacaatcctcatttacactcattgtttctccctatgtactactatgtatcagcaattctaaaataatctgaaatttctattaagtcccttatacctgtgcattttctcaccacgtcaaactttaaatttccaactgaaaatctatcattcaatgattccaaatatttggcaagtcaaagaatataaatgaacacttataaatgcaagaagaatagggaccaaacactgtgtgactgatcaattgcatcattgcttctttctcaagataatataactctcaatactatggaaattgacgagtttcaactcgattcaaaactatcgaagttcgagaatctatcgggcaaattatcgaccaaatcacaattaccaaagctacttcatttgatagaagctgattatagtcagacttctaacgctttaaacaactatatcaaaggctcaaataataaaattaacaaatcggtaaggtccttggagttagggaagaccaatttaacatcaacattgtcttttttccatgaagccttggaatctctatctaattctaacgtgcaatcgatatcaatttccaataggcttaattccatcaaggatgaagcagaccatattaatcaattggcagattttgtagattctgtcaaacttttgaagaataacctaaaaataataaatgatgcattagacacgaaggaaccaaattacccaatgatagcccaatgtatctatgagattgatcagctgccagactctataatacactcgcagtttgttcagcggtgtgtacccactagtgaacttccagatccaccggttcagcttatagacaagtggaaaactcatctctgcaaagtattttctgataggtttaccagagccacaagagacgtggatgttggcacattgactgaatgcttcaaactatttccaaaaattggtgcttcggatcttggaatagatctttactccaaatatatatgtgataacattgcacaacaatccaggacgttaatgacacatacttccggggacccattattttattcaaaatccacactacaccttttcaaaattgtttctacgatgataaacgaccattccaagattattttgcaaagctattccactgatttcatgttagagatcatgcaaaaagttcaattagagactgatctacaagcttgtttgatttgggacaccttcactgatgatgtttcgttggataaagtcttcgcttcattgcaagataataatgacatgaggactttacaagccattatcttacaattttcgaatttcttgcaaaactggtcaatgtactgccagtttttctctatgaagtggttacaattcactaatgggtccgtagatccaatcaagattgtaccatgccttaccagcggtaagttcaattcaaaattgcaggacaatattgacactttccatgcattgactatccattacaccacatactgtttcaagagttctttgaaaacttcatgcatgccgaacttaaatgattctttggatattacattatctcaaaatactgaaagtaatcagcagattatttccccggtattggaagatctcgcgattcttataaaatcctacttggtttggactctaaattcgggacaaactgaattagttacgaaatctttagattcaatttcccaaatgattcaaaatgagtacttaatcagtttcgtacaatcaagcttgaccaaattaatacctaggttaacaccggcattgagattgcaaaaatatatatctgcgcccaattacccaatggatacgcaaagcaaatttacatcgcaattcgcggcatttaacctcaaggagacagatatggagtctgttttgcatttgcatcattatatcgtttaccttaacactatttctacaaatgaatcgatatttaaggatttgtttgagaacgaaattataaagattaatccacactttttgattgataatttcaaattcaataatgaacatgagctagttaaaggtaaacttctatctgtgctacagtatatccttgataataataagaagctttggaattgggcaataatgatgctatatcaaaatgttctgcaagaaaacctacatcgtctactatcggtactgttccaaagaaacaccgaattcttatccacattacaggattttgaagactttgaaaagctgcacaagtttgtagaagagtggaataaactattaaccccatacaaacaagtcctctccgcagcatctttcaacaatcttttgaccactattgtcaaagatgtttgtccaataatagagaacaagtttctatccctacaatttaacgaattaggttctatcaagattgagaaacagctatccattgttatcaaaactataagcatggacaattatcaattacgtgagtggtttaagaagttaacccagatgtgtctcctcttaggatttgaagacgaccagtttgactcaagcactcaagatctaaaagatgacgtgctcaattcattgaactggttattgacatcttctgaacgtatctcaataagacaacaacgtatcgacaaacggtagattggtgtcaacacatatataatatctgtagaggtctatagtgtcacatctctcttaacgtgtaatttatagtcaaattcgttgtcactcttcacgagttgatctttctttttcttcaggttccattttaacctgaaattaagaagttgaatatcacatttgttgatgtttaccatttgtctaaggtaggtcatcggcaaggcataaaagcaacaaatacctgtgtatcgcgatggatacggatcgtagcagtgtaggcataagtcctgccgagcatagcgtaccgttggaagcatcaaaacgcgatgcagatgctacaggaacgattgtaccagaggaagatttaaagctagaacacataccagacaatttggagcatgcagatttctccaaacttcttgaacttgatgagaagaacgatgatgatctgtttcacggaattgatattttagatcagcaaatgaaaagcgaccaggggaaagaagatatagaactacgtgtagaagaaccgaaacgagaaatgaaagaagatgagtcctcaaatgtgaggaatgaggataaacaaaagctagaagcaccagagtctccaaaatctatgccggccattcataatgatgagaaatctgtgaagcaagtttatccattagtcaagcatgaggaaaacacgccagctgcaataatacaagaaagactggcacataatttgcagagacataactcattaacgcctatgatgttcccgctcaaacagttaaacgagctcaaatcagatatgcaaaacctaaagttgaagacagaagacggagcaaagaactcaccccaatctgatcagaacacaagccaaaaaaatgccgaatcgccagaaaatggtcagcaagttacgcaactgcatcctcagttattgcaagctgcagatgtgaacacgcctacctctaatacagtccctggagcatcggatgaacagtcgaaaatttcagcatacgcaaggttagactttcaggactttactttctacgttcaaacacttcaagttattatcggaaggcgatcggaaaatgattactctcataaagttgatgttaatttaggtccatcaaaatcaatatctagaagacatgcccagatattctataatttcggtacgggcagattcgaattatctataatgggtaaaaatggtgcatttgtcgatgataactttgtagaaaggggaagtactgttccgttaaaaaataaaactaagattcaaatcggacagatacccttccaatttgttttacctgatcatgaaggtaatatctccaaggaattggcatcgaaaagtaaaaacagcactgcgaatgcaagtcagcccccaaagaaaaagaataagaaagaaaaagaagttaaagaagttaaagagaagaaggctcctaaacctccaaaacctccaaagaaggtttacactttgcaagaaattcctccagaatataggactaaacctacgtgctcttactctaatttaattacatcttgcttgagaaaattttcaacagaaaagggtatgtctctctcagagatttattctggaattcgtgaacttttcccctactataaatattgtccagatggatggcaaagttctgtgcggcataacctttcattgaataaatcgttctgtaaagtctcaaaggaagggaaagggtggttatggggattggacgaagaatatattgctgagagagaaagacaaaagaaaaaacaggcagaggcacaggcagctaaagccaaagttgcagagctgaagcagcaacagcagcaggaacaaaggctgaaaaagcaacagcaacaaagttctaattccaaacaaccgaatatggcacagacgttagcggctaacagatctgataagaaaactactagcatggatgacaatcaaagaacaatgaaatacttacaagaacagttaatgattttgacaaaagatcgtaaaggtttagataagtctcttatggcacaaattttaacacaagcattagcaatgacaataaatcaagtgacacaggctgcaaagcaaaaaggtatcagtgggaacccattaactgcattaatagataaaaatccacaacatctgaatcttattctagcggctgcagtgaatgccgcaacagccaaggtcacaaagggtaaggtaaatcaacttgtaaatatgcctcctcctacggtgaaggatcagcaaccatccgctaagaaggaaatccctattaaaagagctgtcaccccgaaaccacctacgccaagtgtagtgaatccagtacatgcaaattcatcaaataaagatcaatcatttgaccctacatccttatcaaagttttttcaaccaaagcagcagcaaggctcgaggccatcctcaggtatggctaagacgccaactccaccagttacggtagggacacccaaatctggtgtggttagtaatggaagctctgttccagcgacaagtccacaagctacgtcaacagtggtaccgaaaaagcgtccagctagtgacacggaatctagcgattccgatgatagcaacagcagtgactccgacgaacagaataagaatggtgattcctccggagagtcatctggtgattcgtcttcgtccagcgatagtgatggcgattctggatctgaatccgaaactgatggcagtgactctgattcaaattctgatgatagtgataacaatggccatgataatgatgacggtcagagtgattaggagaacatgatacattcatagattaattaactatcttcattccaaatgtattaaagtgttagttaatatatatatatatcaatcaaattgtaacaataaacccaaaagttacagtcggaaatgttcgatggaagaaggaaacattaagttgggcgattgagtagtgattgcactgaatccacgttgaacggctctggtcgtagttcccacccattaaatacaccatttcggtataggacaaaactatgtatacaatatatcttagtcataggagagagaagttattattaaattatattaactgaagtgagtacaattattgacttaccacattattgaatgatttctccttttcttttatttcccagaataaagtatctacgttatgattaccatgataaacccatccgttttcggtgacgtgatataagttaatggacccacccgaataagcatcacgatgagcagctgcaagaatagaacgtttccctatatatagcgcttcttctaccgatagatcccaacggtaattagcatctagaacaccataagcgaatgtttgccctgaacccacacagaataggtcaccttgcaatcttgttccgtcagaatcgacataataaatggttgggccctccttctttgtatacccacagatcatggtacccattgacaaaccagcccctttatattcataaaccaaattactcaaaatctttgatgctgctgcgacggaaatcctttccttttctcttaattcatgtaaacggcattgtgatcctaaccaagtttcccaaaattgacaatcagcagcaccaccggccatggtacctagcaaaaatgggttgatttcgataactttcttcaccgtttgtgaagcaatccattgacctgcagtggcacgagaatctaccgccacgataattcctcctttaaatctgaacgccaacgttgtcgtaccatgggcaatcttaatcttacaatctggattctttgaatcatcggtgtgagctctcaaaaattgttgcggtgtgctaattggtggcatggataagcttggtgctaattgtttgaattgagagtctcccagcacaaaattttctctcaaagtctgctcatcgttcaattcagtgaaaacactggaacgactgaaatcgtcagctatggcttgcattgtaataggatgcgtatataaattggataaatcttcctcgtttcaatttatgacaaatttagtccaaagttgattcaagtagatgctaaatcctgattgtatattatgacttctttcttcttctttaactgtacccttttgccactcaaggctctaattgtttaagttcatataatctcagaatgaaggttgtaattcgggtttgatatcaacgattgtatgggactgtcaaatgtgtagggtaacgatacatcatccgtacattctctaaagtatccagaattccaaattcatggtgtacggatggttaaattaaaagtgtgtacatgatattattactatatagggttatttagtccgtgagactcataactcgctgtgcggtaagggcgatgagagacatcatctaatacgacaatataattcccgtccttggtgatcatttggttctgctactgcgatctttgggcgacaacgcaactctttttttttgtttggagctttcgcctagtgaaaaattcatgataattcccaatggatggaagaacagcttgacctagggactaagttacaggtttgatgtaggattttttttcattgaggtttttcaacattggattcactatacgtttaggtacatctattacatatttaaaagtattctcgtattagtggtctatttcttttattatttgtaggttttattccgctgtacacgtcaacccacaaccccatagtccaagatgtctgctaaagctcaaaaccctatgcgtgaattgaagatcgagaaattggtcttgaatatttctgttggtgaatctggtgacagattgaccagagcttccaaggttttggaacaattgtctggtcaaactccagttcaatccaaggctagatacactgtcagaactttcggtatcagaagaaacgaaaagattgctgtccacgttactgttcgtggtccaaaggctgaagaaatcttggaaagaggtttgaaggtcaaggaataccaattgagaaacagaaacttctctgctaccggtaacttcggtttcggtatccaagaacacatcgatttgggtatcaagtacgacccaggtatcggtatttacggtatggatttctacattgtcatgggtagaccaggtgccagagtcaccagaagaaagagatgtcaatctaaaatcggtaactctcacaagacttccaaggaagacaccatcgcttggttcaagcaaagatacgatgctgaagttttggacaaataaacaacccatttaaactgaaaaagtgtcctatctatcgttttatcaaagcaagaatattattatatcgtaatatatagataaattattatttttactgcaaatattagaatatctatattgttgccttttctaaattgtcattcaacgtcaaccgccagcggttattcaatgaatcaatttcctgtctatgagattcttccatgttagttctgtattgagataattgttccaactgttgtttctgagtttctagcacacctctgatctgttctgtaactgacttcaacatttcttcttgtacaataagctgtttcggcagcgttttggatatcagtctttcgagacacaattcctggtgcttcaaatatgcgtatcggacttctgcggacatttctggtctctcaagccatatttgacttctccatttttcaatattgccatccacatcctcataaacattgaaactttccctcaaacagccgtttacttcaatttcttctcgaaatatgtctgccaccttgctgtgtaacgtcgtctcatcgctggttacaccattggcttcaagagtaattttctcgagatactcttgatatcccaactcagtattcattttcagtacagagttcatgtttggtctggttatttagtcttttcggagctggaattagcgaagagtgtttcttagaacagcttatcgatgattgcaattaagcataagtgccccaatgtctttatgcatagacaggtttttaatatggtttttgatatcatcttgtacgtgttgaaaaatttcatgttttcaacatttctatgtagagcggaaactagccagaggaaagcttgaagattgaatcaccacatcacagtagaaaaacacgcttcatcagctgcaatcattgggataactcatcggttattggcagaggtaacacaattaatactctgatttggttgaaaaagccagcggtaggaacaaaggtctgattttaatcctcatataacagtcaaagcagcgaatgttctctcggtttttcacaagatcggtttcaactggtgtagagtctcgtgcggtctttgacaacttcttacaatttgtcaagacaccacagactctaagaccatacatctaccgcaaaaagaatgctaaccgtttgttggccatggatttgaaagatccagaaactaaacttcctattcaacctagaccatcagtgttaagaccaagtgcatcagttctcaatagcgtcatattgaacgcatcgtcagctgaagagttggaaaacatggttagagattggaagaatatcacacctagaaggaaagagttctggagttatttgattccccagcatctacaaaacatgttgttaacttccactttcaagtttggtgctttaggagcagttttgaatgttctgtaccaaatacagccattattggtgaaagcaaagcaattagaagcctataacgtagatgtatggtataatactgtattgatgtgtcaattgcatagaaatgcgttccaaaacgttcaagattccggcatggtagagagaggcctaaggaagttatcatcgactgttaccaaaagagaagatacaactggtttaacaaaggaaattgttcaagctttgggtagacaacagaacgttgaggtgaaattacctaatttcgctagaaatattgaaattaacttgccatcgatcgatgttagcactgcaagccaaaatcaattaaggactttcttgacaaagaacaccacccagtatttgttgagcagaacagcattagacttcggctcaactgaagctaagctgcaacagtttgttgaaaactatcaagccgttttagcgcaaaactcggttgctgacatttacgacaaatacgtatcccaatacaaacagctgttaactcaaaaggctactgaatctgaaacgacagaagaagctcatgcagatgcacaagcagaagaaacgaaataaaggatagacttatccgtaaccaatatttcccagaaccgttcatgtatatatatataagaatcaacgtcagttaagaatattactagaaattcaaaaaacattaacaaaatgaccataattcataaagaaactcacacaatatacttctattatataattattgatgtgccgtcacggattcatcgcaaattgagtaaatgttcgtcaattagcgcctggtaccatgtcactcccgctagccaactcgggcactgagtttgttcgatctgcaaggaaatcaccgtcaacgagttttccatcattctttttaagaatttcaattttggtgaaattattcaaaagctgacataaataccaatcgatgatctcgcagttcctgtgatccaacggaaatctattggcaaataacggtatactttgaggtatcaaatcaccaataatgacaggaggagctaaggaggcttcagggaaagaaactaatactgaaaagacggcaaatgcacaagaaggagaaaaacctttatctaataaagagttgaaggaactgaaaaagaaggagaaggctgcaaagagagcagccagtaagcaagctagtggtatctctattgaaaaacagcagcagcaagctgctgctaagcgtgaaaagaagcagcaacaaagagatctcttagctgcaaaaaagaataaagcagccgacccggtcaaacatgataccaagaagtcgactctatttggtcatctagagactgctgaagaaagaagagcttctttacttgcagtttcgagtgctatcacttctacaggtacctcaaggattactgctaatgggttagtattgcctttacttgctactacacccgcggttgcggtttcccaaccaatgtctgcatctcctttgagttcaaacctttctggaagcaatactaatttggcaggtttggctcattcagaagattttgaagcccatcaaatgctaaattccttgtcccttgatgaatcgtcttcatttgtcccaggaatatcatccgtcattccaaataccatgacttcacaatttacaaatcaacaatcgattgcctctgtaaaagaattgattgccaatcgcgaaatgttacatcccgctatcacctctctgactttggattatgcattctataaaattataggttccattcctcgttgtattgccatgttagaggcattccaactggttgtcagagactacaagactccagaaggtactactctttcacgtaatttgacaagttacctgtcccatcaaattgatttcttgaagaagtcaagaccattgagtgtaaccatgggtaatgccattagatggttgaagcaagaaatctctctaatcgatccttcaacaccggattcaaaggccaaaaaagaactttgtgataagattgcacagttcgctagagaaagagtgcagttggctgatcaacttatcattgaaacagcttcacaacatattgaagaaggcagcactatattgacctatggctgttccaaggttttaactgatttattcctacacaacgccataaatttcggtaagaacttccaaattgttatagtggacagtagacctttgtttgagggtcgtaaaatggcagaatctttgagaaatcaaggtcttaatgttttgtatgttcccattacagcattgggtaccgtattcaatatggatatcaaatatgtgtttttgggagcgcattcgattctttcaaatggtttcctatattcaagagtcggtactgctcagatcgctatgttggcaagcagaagaaatattcctgtacttgtatgctgtgagtctttaaagttctctcaaagggtacagcttgatagtgtcacatctaatgaacttgctgatccaaacgatttggtaaccattgactctgctaatcctgtacagagacgtaacaacaatgggttcttattacagcaatttatcaaagagcgtgaagcgcagcagaaggaagtcgagaatagctctaagcaaaataataaatctggcagtgctaataccaataatgctactgccgacgaaggtaagaatgtcaaggataaaccaatactagcagagtgggagaaatcacctaatttgcacatcttcaatataatgtacgatttaacaccccctgactacatcaagaagatcattacagaatttggttcgttgccaccatcttctgttcccgtggttcttagagaatacaaagcatcagcttgaatggagccctttgcatatataatatacgataatatcatataatatagtaaatgaaaaattagtatagatcttcttttttattaattgcgtagtaatattcaacatcgtaggttgtttacttaggtatcggcttcatcgaggatattgctatatatatgtacaagttaagctatgatctcgatattaccattcacaagtcattttttcgattcaaaccttgtgtctgatggctgggcttaaatgtagtggagaccagatacctctcacactatcgttcaaagtatccacattgtcgttcttagttctgtgacggagttgctcaccagatgcgtctctgattagttttaacttattctctacattatcaatgttcagattttttacgcagatggctttattacggccattaacatagtcaccttttataactggatggccagactttcttactatttcgaactgtattgttggatatttttcagcccattgaatcattctgttagacgttaggaaatctctcaaaccctgtgaggaaccaccccaattacagtattgcaaagtgatctttttacatggaagcacaaaagcgccaacaccatttcttgcgatagaagtttgtctcaaaactttaacaaccattacttcagagaaatctttatgaccgcgggtaccagctctgattagaaaacaagttgggtgtattttgaaactgtggagagatccttcagatgcagaacatagattcactaatatatcttttgagttttattcgagttttcagttcatgattatttttttccaatttcaaaagaccatcagtcacgtgaacaaatctgtatgtattcgaaggtaggaggacaattcaccacatgctcacacaaatgaaaaagatactggtaccaacactgctataaggtgacgaatgtaaataatacagaacctctttccgactatattctgtttctttcacattgctatgtcaacacatcctcatgagatgtcatacgtcatgtaaacttgatgatctgtcgatgggttatgacaataatgcactaccagcgtttggttaagggtacttttactgagcaaatccatagaaagtacgatagaggccccagattctgatccaagatgtcccaaaggcttcatatgaggttaattaaataaagggcctgatttgcgttcacccatggaatgtacggattgacacctagcgtatgttggatgcacactagtaatttgttaaaaaaattatgcacatgcgtcatttaaaccaattaactgggcactccctattaagtgtgatgtaagtgtatgacactttgttcaagaacaggcaaatgtattgccataatagtcaccagtttatcattatggtgcgtataatgtccctataactattgaaaaattaaagttctatgcgtttttttaaggatgcgtataacgatgaccacccctaaaaaacattcacttgtaagtagcgaacagtcaaggtttgtatccgtttctttaatttattacggcgttcactgaagcgtttcaacgatgcagtataaaatgcgacaaaaaaatttagggaaaaaagcagaagaataccatactaattaactggaacttggtaattcatcaacggtaaatacttataaggtgttaagagtttattagcgtgtccaaagtaacatttgtattatataagaagggcagcaaatggcacttttttactaccattttcataccttttacttgcacctttatttcatgtcattgaagaattcttaatatacatagttttccttcagattaattaaagattgaacaccctcgaacaacaacctaactttactacgctcattaaaaacgattataacgctaaacttggttccctacccatacataccttttgaaattattttctctgtcactaaacaagaaagtttcaaaacgtcagttttcagaagcttcaatacctcgctacagaaaaataaaatcattcattggatccaactttacgtctatccttaaaaaggaaaaaggagtgtgaattagtgtgaacattgaactcgaagagttgcaataatcatagcaccaccaccttaaaaacaataaaaataaatacagtcgctcgtttgaaatatattttgctttcaatttaactattgaaagaacctgataccaaaaacccaagaacgttttctaagcggctttgtctgagaaaacctgaaaaaacctttttgacacatttctgcaggcaaacttcttttgtccctgcattagaaaaaaagaacttttgtgaacacctaaccaaggcaaacctaaaacaaaagctacctatggagcaatatcttaacttatccgatgatggcgaagcacagcctaatttggatttggaattaaaatccttctttgactttagtcaagattcatcaattaaccaagatccttctgcagttggtcccaacaatactgcttattcagaacaggtttttcctgaattcacatttgaaactgaatctagcggaaaagagtttcaatttggttctattgcggagttgttacaggacacaccaatgagtagagatctagattattccacagctactgagacgtccacgccacatttcacctatatggcagataacttcttggctagtaattacagtttggatgaaattgctgcgttaccgaatactaatgagcaaattaccattagtaacacaaataataacaaaggtaacttgatgcatttttctgtcggtcaatcgatgttgtgttttaataacgatatttttgacggtagaagggaaagctttgtttccgatactgttactccgattagttccaacacaaattcgccaaggagtaattctgtcaataataataaaattaacagaatcaacaacatgagggcacagaaacctaataatgtgaggtttagtttcaatcatgtaaattcatctccttttgctgttggtagctcttccagtattgcagaagtctccatggattcgatgtttccaccctcgcccacgaagacaccaacgaaaatgttgccaaaaactaagagaaggaaatcctcgtcatcttcttcaagttcagtttcatctctaactcaagatcttttgtcgatgaaagatagaagatgcatctttaaaccagccccaaagaaaaaatcagagctttatctaaggccagaaagaagatgcccaaaattcgagtttggaattcggtcggaagataatgttatcaacgtaacgttccaaggtgggttcatcagaaataccatcatggattggtatttccccagtgacagcgctcttccttctaattttcaagatgtgacaatcgaatacgatcatgattattacgctaaaatgttgaaccatataaatacccaaatcgctatgcaaaatgaccccaacatttcaagtttcaggacatattggaaaatcttgaagtgtcaaactgggccacatatcaaattgcagttcatttctgaaacattagattgcgatgttaatttttcgaacacccaatattattttaacattgtgtcgagaatcgtcagacctaaaagtttcggcccaatagaaagcggtgctaggtatagggccaagatggtgaatgacatgaaatcggacgatagtactggcaagccgagatggtgtcattttatcaccagtgctgagatgaaggggattttagatttcatctttgatggtcttgattacatagctaatgatgacactttgccagataaattatccaaaggtataaaaccaaatccgttcaagcagcatgaatctaggataagatctcatatggtggggtatgtttccggtaaaaaatgtatgaaagatgctaagaatgtactaactggtgaaaggaaagtctttgccgaggaaatgtataagcaggtcatcggatatgacgataaaaggagaccgtataacactttgaaggaatttgctgttatggaggttaaatatatgatggacaacattgaagatttgtttggaaaattctattgggtcgatcccggaactgtgcccaccggagggtataaagtccgcttctgaggtgttgtgtcatattttcactaccgtaaagcaacatctttggataatatcagaatgagaaagaacagatacgcagtacgttttttggtgagctctttgcacttctttagttctttccatcaatatcagttgcttatgcacttatgactaatattgatgtttaacttcaatatctttaaacttttgttcttcccgacgttcattaagaatactaatacactttaataattagtttaatatttgtttctatataatgacatttaattaaaaaagataaaatataaaaacatcataataactcaccagaggttaagaacaaaaaaacaaattagatatctgctaatccaatatagttaaatcaatctttccttggtataatgggtatattacatatatttcaaggaccgacactcctaccaaatatctaaaatttaccatattaacataacatgtatataaacgtcaaatcataatcagcactaacattacctaaaatacctattcatataagacactacccagacttggtttggaaatgattatagcatcttctagttcttctgcagtcaattctggaaatctcaagttgtaatattgttcagtcaatgcactcttgacagagtcaacagtgtcagtagaacataagtgtactgtacaaccaccccaaccggcaccagtcaaacgagaaccgaaagaaccattcttcaaagcaatttcacaaatggaatcggtctctgggcaagaacattcgtataatttgtcacaagattcctgcgattcattcattagggcaccaaattcttcgaagaaattggattcacctttttggaacaattgtaaggccttcaagactctcaaagcctccgaataaacatgcttagcacgttgaaataacttcaatctttggaaacgaacaggaaagttagttagatatagttcagtgaactgagagatagattcacacccgcacagttcaacggcgtgatctagggtgtatccattcgggtctaaggtttcttctactagttgcaacattttattcaatctttcgataccagtttgaatttcgccatcccatggcttacggcacgatttgtcatatttcgtgtaatatgaatccataaagtttcttagggtacccttacctaggttaccttcagtttgtaaggtaacaccgaatttctgagccaaaacgttagcagcgacggtgacttcaacaactctcaaattataattgacaggtccggtttccgccttattactaaccacaagagtgttcgcaatcaagaaggaaattggcaaatcttctgggaacttgaacggagtagccttcaattctggtttgaactccacgtacaaagcgtgaccctcgataccacaaatggaggctgcttgatccataccaccgttattaacaccgacatgatgttccgctacagctgtagtctttgtcaattcatccttgaggattggcgttcctgcaggaacattagagtatatgattgccaaagaaaccgcacagatgaaggcagcacttgaagacaaaccaccaccgctaggaatgtcacccttgacgtagatttccataccatgaactggacccttgaagttgtatttctcttgtaagaattgttgagcgactaggaggccacacttgaaataattggaccagtctgacactgatgggtcaatttcaatcaaggatccatccaatggtaagtcgaacttacgctgagcaaaattgctatcatgattagtcaaagtaatggatggattctcgctttcagaagttaagcggcacgctagcatcaaatcgttttcaatagccattggcaacactgaaaactgacaataatcgatatgttcaccaatcaaattaactctaccaggagatctggttataaaaaacttcctggaatcatctgtatcataacattccacaaattcattcttcaattgttccaattttggagcgtgagcaaaatctgttggcacaataggaacggacattattatttcttatatttcagccttgtttcaaacctgttgtcacttaaaaggattctacgatcaaatttccaactttataggttgaatgatattctcacccgtctattgaaagatcaaacctggtatcaagatatgtctcgaactgtcaaaccttttaaatgtaatttcaattcaatagaacggttcttttatagacctttggaagcctgctccatcatttaacagaacggctaccgagttttcttcggatcacttcaatccgtatcacgtgatacatacggattgaacgaatccgctctacggaatacaccaatccggaatgagcggaagactatgccccggatgccccagatttttcgtttctcagcaggcaagctaccgaccgtactattggtaacgagagatgagttaggaattaaacaccgtgaaagaaggaaagaaacagaaattactaataagttgctatcataacacgacaacctgcttgccttgcaccttgaagtgacattgaggatcaaatcccctttacttaaaacacgtatgattgcatgctcaatacgtatataaacactgagtccaggcaattgaatccaaataagaacagaaggcaaaaacagtaaactgccttccttcaatataattgatataatagactaccatttgaaggatatctcttatagaagctgtcactaagaaggaccaataatctgaatcaggttaaaggaaactcctcgaagccaaaaaaaaaaaaaaatcaacgctaagatgtctgaagataaatactgtttggtgactggtggtgctggttacattgggtcgcatactgttgttgaactttgtgaagctggttataagtgtattgttgttgacaacttgtctaattccagttatgaatctgtcgctcgcatggaattgttgactggccaggagatcaagttcgcaaagattgatttatgcgaactggaaccattgaacaagttgttcgatgattacaagatcgattccgttctacattttgccggtttgaaagcggttggtgaaagtactcagattccattgacttattatttcaacaatatcgttggtactatcaaccttctagaatgtatgaagagtcacgatgtaaagaagttagtcttttcctcttctgccactgtttacggtgatgccactagattcgaaaatatgattccaattccagagacctgtccaacaggtccaactaacccatatggtaagaccaagttgaccattgaagatatgatgagagatctacatttctctgataagtctttctcctttgctatcttaagatatttcaatcctattggtgctcatccatctggtgtcatcggtgaagaccctttgggtattccaaataacttgttaccattcatggctcaagttgccattggaagaagaccaaagctatacgtctttggtgacgattacgattccgtcgatggtacgccaattagagactatatccacgttgtcgatttggcaaagggtcatctagcagcactaaaatatctggaaaaatacgctggtacttgcagggaatggaatctaggtaccggtcatggtaccactgtgctacaaatgtaccgtgccttctgtgatgctattggtttcaatttcgaatatgttgtcactgctagacgagacggtgatgttttgaacttgaccgctaaatgtgatcgtgcaacaaatgagctagaatggaaaacggaactagacgttaataaggcgtgtgtggatctgtggaagtggactcaagataaccctttcggctatcagattaaaggtgtggactccaaattctttggggataagggagatttttcatccagagttgtatctctaggtaaaggtacctcattcgaagttaaacttgctaaccttggtgctaccatcgttgacattgttgttaacgggtgttctgttgttgcatcgttggataatgaaaccgaatacaaggatcaaagcaatccattcttcggcgctactgtaggcccctatgctaacagaatcgctaatggtaccttcgaaatcaatggtaagaggatacaactaactgtgagcaaagaagatggtaatgtagttcattctggaatcaacagctaccactctaagaaattcttaggtccaatcgttaagaacccggaggctcatatttggactgcagatttcaaatacgtagatgaagaaactgaatttccggccaggttgtccactttggtaagatataaagtcgacagcgaaaagaagactttgactgttgaatacgaatcaaaggtcgcgggccaaggctctacaggtgccaacatcactaaccacacatatttcaacttgaacaaattcaatgaagctactattaagggatctaaagtacaattgatcgacaacaccggtctcgaagtgaataacaagttgctcccaacaggaaacttaaagaaatatacccaagtggctactttcaatgattccccaactgaaatcacagagaaggaacctgtcttagatttctgcttcgtaagcggattacctgctaaactagatacaagatcttctccgctaacaccggtgtttaaactatctaacgaagatgctaagttggaagtggaagtggctaccactgagccaactttccaggtctacaccggtgattacgtcgatgtcaaagataaatacgaaaacagagctggtatttgttgcgaacccggtagatacattgacgctgtcaacaatcctgaatggaaatcgagcgtcgttcttccagcgggagaaacctatggccacaagctttcttatacttttaggactttgtgatggaaatacatttgacatagaaaacactaaaccaaataaaaacttaaacacaataacatgacatgattgttgatatatgagagtatgtttcttgtcaacagttttctttctgaatcaatatatacacatactacatagttttaccttttacgacttatattgcataattaaaccccataataataaacaaataccattgacatgacagataatatttttttatttcccacatgtcgttcctaacacgcagctacatgacagtatcgaacttcgaatgtgatcgcaaaccaacgtgcttgtgaccagctgcatgcaagcaaatgacgatgatgataaaagttgtgtcggacgacaaagcttcagtgtcaccggatttggttcagttattatttttcattggatatggaaacttcggagttgagtggtccgttcccgtctcggatgattgtggtccgatggacaagctgattcgaaggccctttcgttctctttacggcaggttagcaaggccgtaagctcatcgcttgggtatgtccacgagctacactctctgtacggatagtttcttagcaccgtcaacaagattaaggaactgaatggtgtattgtttcattatggtacaggattgcaccggagcactgtatttgtggagctacttgtgctaacagcacgagagtgcccaatttatttcatcaagtaagtttagctgcgaatatataaagtaaagctgtagatggaggatagacttgtcattcgagaattggtttgaattggattcagttgcgaataattcttttaacatacagatatagaaaaccaatcatcaacattgattgatacgagcaaaacagaataacaactaacatcagcgttttcaaacggttaatataatgtcttttgacttaacagatcactcacatgcacgttacaatccattgactgattcttggattttggtatctccacatagagccaagagaccatggttaggtcaacaggagaaacctggtagaaacgatgctccagaccacgacgataaatgctacttatgtcccggtactaccagggctacaggtgagcagaacccagattacgaatctacatatgtcttcactaacggctatccagctgtgaaattagaacaaccagatccagaactgacggtgtcgaattgcgacgcattgaaggagagattgttcaagttgaaaggtgtgaaaggtaactgttatgtgatctgcttctctccaaaacataacctaagtttcccacaaatggctcaaagtgagatcatgaatgttgtcaaaacgtggactaacttattccagactttggagaaagaagccttggaagagaacaagccttataaatatctacaaattttcgaaaataagggtactgctatgggttgctctaatttacatcctcatggtcaggcttggtgtttagattccattccaagcgaacctgcaaaagagtttgaccacttcgagaaatatgaacatcaacatggtgctcacttgttggaagattatgtcaatttagaacttcgcgaaaaggaaagaattgtgtgcgaaaatgattctttcttggttgttgttccatattgggccgtttggccattcgaaaccatggtcctctcaaaacgtcgcatcccatccttgaatcaatttactgataaagaaagggaagatttagcatctatcatcagaaacttgaccatcagatatgacaatctcttcgaaacgagtttcccatactccatgggtcttcaccaagcctctctcaacgctaccgaaggagaattgaaagccgcttggttccatatgcatttctatccaccattgctaagatcggccactgtgagaaagttcttagtagggttcgagttattaggacaaccacaaagagatttgactgctgaacaagcagcagatagactcaaagccctaagtggtgaagtacattatttagcaaaacttgagcaggaagaaagcaaaacttgagcaggcaaagcagaaaatatccgtataggaaaacttatttacaagttatactcacataaaatttccaaacttagtcacattcgtaagcttttagatcctacctaacgttacttaaaattcatattctaatattgaatgctgaacgacaggatcttcgttgtctagaacagaaatgatgtcttctttaatttctggttctggaatggactcactcgaatgatgataaagtatcaacaatgatggcaaggttttgccatatgtgcatgttacaaattgtaccttatcgccagattctgacaacagatcagggaattccttttctatacccttaatggcgactttcttggctatgacatcatgtggataagagtcttttgtgttctctaaaagcaccaatgccatacttgctgcaacagaatctttaccatttaacttaacatattttgtgagtgcgcccagagccaaagctagcttaccagttctcaaatggaattcaaattccagcaaatgtcttctcgtatcatcagtggtttgggataaatatagtttcaaaaattgattctcgaataattccaaaggatttggatcattgagtaaagtttcaccaaatggatccttgtcatcaaggtaggcaagatacttggccttttcttcttccttctttttattcaaagcagcagcttcttttttggcctttttgttggtcttcttcttgatagaactgtcatcatgctcttgttcaactgatgcagttagttgcaaagaatcaaatcttccgaaaattatccttgaagcaccttccatagccctaataaacataggcaaagtatagaggtggtttccccattcaagcatattcacgtaggctcttggtgtcccttttctcatacaataggagtggaaatctaattgatcatcctcaaattgcttgtaaatcttaggaattgccatataacgttttaaagaaaggccctcaaacttattaacattgaattccaattcttttagaagttttccatgagattctatctcatcaacggtaagtgcagttatatctttattcttcaagccgattaattccttgcaagattttttatacaatctgaagaagctctcagcttgttcgataatgaaccaagaggcttctaggaggtgtaaatctggtacaccatttggagattggtcgtttttggtaaacaatgacacgatcttagtagcctcatcaattttatcagctcttaacatgtattttacagtctttgcattaataaatctatcttgcaggtcaagttcgcgacctttatcaataacttctgaagcttcttccaatagccccaaatgcttcaggactctggacttgagaatatatacctcaacaagagttggagtgtggttcattgctttgtcagcatatgcattagcctgctcgaactgctttctatgcaaataatgtagagccaaaaagtaagttgtccaaacaaattggattggttgatcagtcgatgatagctcagcataataaggtaatacaatactttcaacaatatccggaataccttccttcttgtaaagaggtttgatgttattgaatgtggctggaacaccgcgatttaactgcgttatgatataatcattgagtttcgcggttaattctaccttatctttgaggaatgtgagcggaatgaatttaggaggctccgatttagggtaaaatatagccaacttttcatataaagctttcctcaacttctcatttccttgaattccaagtgaaacttccaatagcctgtaatatctgaaattgtctggacttctcttaatcaaagttctgtacacaatagaggcttccttagaccgaccaagtttcattaaaatagaagctttcctctctaaccagccatatctatcataaacatcgtcggaaatcttttccaaatgctctaaaactctttccaaggattctttatcgttgcctgccttcttgtacaaaagatcattcttgtacatgatacattcgttgttctcatacatttctggttcacccaacttgccttcagcaagctcttcaaatgtcgaaagagtattgattgcgtcttgcgtacgcccattcaaatcttgtgctatggccaatgaggtccaattggcacgatatcctctgtagttttcccagtacttttttctcgattccagcgcgcctttgaaatcatgaatttgagattgcaatgtcgccaaatctctatagatttgagtgtttgtagaaccattttctaatgcggccttgaaccactttacagcgtctgagtaatttttcacctgtctgtaataaattcctaataagtgtccaccaattggacttacaagagtgcctttaattttggataacgctttatcaatgtaactagcagcttcttcaggtgtactacagaattgcaagttcaatcccttcaaaattatagagtccacatgactgctgttcttcttcaagattgtgtccaagatcttcaacgacttcttgtaatttttaccttcatatagttgcagtgcttccaacatattgctgtcatccttagacctaccaattggaagtcccactttcccgtgagatagtcccttttttttatacatgctagtgtagatcaatgggtcgctgagtgtagataagcaagccagtaagagtgtttctccatttattcagtcatgaatatgattgttgaacttgataattttcatgatttagacgttgactattgtaaatttttcagtttagagatacattgaaaatgaaatgtttgggtttgaacgaactgaaggtaatagttagcaagcggagctggtacgattcaaggagtttattactcacctactgcaataaagttaaaacatgttgcaatccaatgatacttttgatatagttacatactcacatttacaaatattttacgtaattaaagggaaacagctgacacttttgaaacgtagggtttctaacgagttaatgtaaagatcaaaaacggaagtcaggctcttcttccactttctgttttttatgtaagacattatcatcgtccttctcctctacgcttgttgatcgtttgttcgtaatattgtaagaggtagtggaactgattattgtagatccgtcgacttcgtttgatttagcttccgttagaacagtaaataagggtctattttcatcatagtgctggttgactacagagcctccatcaattggcactaagcctgaattattgttttcatgtgtctcgctttctgtttttgttgcttccgcttcattggcgtctgaagacacctcatcgtcggaaattgattcgttcaacggatctggatcaatatgtgcgtcttgatcttctaattcttcaaatgagaacatggctccgaataagttttgtttgggtattctcaaagtatcttcagggtagtatccgtattgtgtaccggtaagattagagatttcccaatttattccacagactttcataccagggtatgatttgggtagtcctaatctattcatttcatgacaccaaggcgggagcatcccctccgtgagatttaatgcctcccttaaagtttccgatagataccctggtctatatcgtgtctttatttgtttccattcgagttcactatccaaacttctgttttcataatataaatcaccaaatgacaatagttcaggtttccaattctttcccaaagtgaaaaatgcttcgtacaaccttttataatctagatctaatacacctagcttgggttgaacttttgctctggtaatatccttcaatttctctgcttgcttttcgtttccagagggaacagtctctcgcatcgtttcaatatcggtttgtctaataatctcaggtaattgaaatggcttcctttccatcattgatcgtccagataaataacctcttttcatttgccaatgtctggggatccccactgtattatgtgttgtctttatagctgcattgaaataaggccattgcgcatcgcagtcaaaccattcgatgagttccggatatggtactgaagctttcaaaacagcaatacttggtttgttagcaagtctcttttgtctttctgatatattttgaagtacttcatccgcttgatcctcaaaactgtcggaaccctcagcatcctcatcgtcaatatcagcccgttcttttcgtactatggcttgttcccgttttgaatcatcatcctcatcggcccctgtagccgaagctttaaatctttgtaacactttattgagactttcatccttgataactaaaggttcattaattacctgttgcgaggtgttgccattctctgatgacacttgttgtaacaaactggaaagcctcttcttcctttcttctgcatcctctttcacagatccatttttattctttgaacggcgtttattagccttggctttctttaccatagtgcaatatctggtgggcagttgactgttgttatattaataagcagtcgagccagaatactattgtatgctcatctgtcaatttgccttttttatgtcctttattaagaccacatatatttttcaattaaatgttgaaatttataccattatattatacgtgaacagatatggcaacattcaacggtcttgtatacatgtgatagatgctatatgactatggataataacgaatcactcttctaaattcttgagtctatcgttgattgaatcggcgaatttgttaaattgtacatcatcgtcattcactttccgcagtaagtcctgtaacttttgctgaatatctgaggctatctcaaacacggtgggaacatcttcgttggaattaccactattttctgatccttttggttcaggggtaacaattggttgtgtcgaaatcatcttttgaagtgatgactgcatgtatatggctgtatgtaagctagatcaatagacttcaaggtatgtcggttctatgacatttacattttttttagttatttgaatccgatccaaattttggtgatacaaatgatacatggaggtgatgagactaacaatggcgagaacgccagctggtctattttgtccatgatagcctattaggtatacagatgagttggaaaggggtttttgcaagttcatttcccaaagatactttacagaagtatattgctgccaatgagagcatcgccaactctaccgtttttcaaggtacgctatatgagctcacggtggtacgagaattaatgaataagctccgactggaggatatgcaggtagttggcggttcatatgatggcggcattgatattcggggcaaatggaacgttttaccattaacaaaggctatagaaatgcaaatacaattcgatgagctacctaaacgtttgaaacttccgactacatcgataaaaccatggaaacatagggtgaaacccgataaatatttagactgttacattcaatgtaaggctttcaattcagataaagttactggccgccaggtacgggaattaattggatcattctccatgcaagttcccgctcgtaaaagaaactcgagcataatgataatgagctctccaactttgtttacaaaagatggaataaggctgtttaatgaggccgcaataccaatggtatttaccaaagtggatatgatccagagattagctgatggaagcttcgatgtgaaaaactcgggaaaactacagcattattatgagaatgactatgcatcgaaattacttgcaaattgtggaatcaaagaatggttaaaattgaaaggttatgagtccttagcacaaaaatgaaatattagcacgcaattacgctatcagaaaagtttaaatagaatgaaacctgtacatatgatgaatgtaataaatatgatatgctaattaatttaaagatgtataaatttataaaggttgtgtatctgattatgcagcgcatgaaaacgagataggaatgtatatagtagccaggttaaaattatgtattaatgatgtctcgatgttgaagggaaggcgtaagttttaaaacaagtttgggaatagttgtggatggcattttagaatctcttcatattgaagcccactgctaatgtcttggaaatcatataacatatagcagagacaaatgacgtgacaccgcaccaaattacatagtggtcatagcccttgaaactcttttctggtccgatgatggcacctgtaataggaactgctactaaagtaccaaatgcgacaacaaagtacattgtagaatatcttcttccgaattcttcagtctttgagatttgtccacagcagacaggtaagatactgaagatacttccggaagaaaatccataaatggcactgaatgcgaataacaccgctctggtagtggcaaaaggtaaccacatcacaaaagttattatgccaagaaacactagcgtaatcattgcaacgttaaaccttccgaagatatcactgaagaatcctggtaaccatctccctggtataccggcaaggttaactaccatgaccaatagataactatcagattgcgatagaccttgtttcattgcatatgaggtgaagtaggtgataccagagattatgctaatttcaccaaacacagttcccatgacacagaaagtgtacttcaaatctttgaaaccgaagatatcaaaactttgcaagatgtaagtgttgaaaacacgcctccaagtaggtattgctctttcacgttcatttaactttttatgtggcaatctctcctttgctaagactaaagcgacaatcaataggaacaaattaacaaatcctaaagttctaaggccccatacgaaaccataaaatgggtccgagtccttctccattgcaaagaactttcttagaataacagggaaaatgacaccaccgatggaaccgccagtggtagctattgcagttgcggtaccacgcttaaccaggaagtaatgagaaggcacactgatcaatggactcattagaataccattaccaagtccggtaacgattgaaaaggacaagatgaactgccagagttcagtagaattagccataccaaagagcccaccaacatgcagtacagaaccaacaatcaatgggcccttggcaccgtttctgtcaaaataagttcctgaaaagatgcaacttgcgaaattaacaaacgaaaaaatggagaaaatccaacctacggtagatgatgaggtactcgacaactggtttctttcaataaagttttccatgacaccaatagtgttcaacataccgaaaactggaataaacccgcaaaaacaaccgaatatcaccaaccatgcggcaaacccaccttccggataaaacaatccgtcatcctgaatgaagctgggtctctttacgccagactcaacaggcctcgtttgctcgttataagtttgagtagcctcaagatcagcgaacttgttatcaacgtccacttcttttctcatcaatagctgccgggacgattgaggagacagcatagctggtctagaaatcttttcaatagtcacttcttcggacattttttcctcaatgggtagagtatacaccttatgccttgaattctgattagcagtgctagcatggtggcctcttgagtatgtctgagagagttacaactctctctctgtagcactcattgctcatcgctttatatgtcaaacatcgaatttttcgaacggcgttcgatatccgcttttcctttacgaggaaagagtcacactgggaccaagatattacataacagtaaacattgcaccgggctgaaagttgatgctgacattgaattgaacactaaagtgcaatgcccgcaatgcccaatttacggtacgatcgacaagataaatttgtaagttgctccctttaaacctggtttacaaggatcctcactaacgtgacgaaactttctacaagccggtagaacgctcgtttgactgcatttgagtccacataaagcagaaattgtatacataaataccaaataatacattactcacgtgtaaaaaaccactatcagggccctaaatgccgggactggcaacctatattgttcgttttcccacaggaatctcgaaatctcaaaatttttttcatcccattgaagatggaaaagaaaaatctctaaacttggatctttgaaaagataaagccttagaggagaaaccttgactgtttgtttcatttaacaaaatagaattgatttgggtgttttccgtttttcactggctcggagtttcggagaattaaggctgagtcttgattgctaacaattatagagtcaatttgttttattcttttgaagtaggtccaggatcgaacttgtataaatcagatagcctttcgttagatacttgagtcatctgtcgaagagagaagcatcaacatcaaaacagtgaggaagcacaagagctaaggaactagaagttcaaggaaggaaacaatgtcatcccagccagttgaattgaagaagaagccaatttcattctccaacattttgttgggagccggtttgaatatgtgtgaagtgactactttaggtcagccattagaagtggtcaagaccactatggcagctaatagacaattcacgtttttccaagccattaatcacatttggtctcgtggtggtgtatttgggttctaccaagggttgattccatgggcatggattgaagcatctactaagggtgctgtgctattgttcgtatctgcagaagctgaatatcactttaagaaattgggattgaacaatttcggtgctggtatcatgggtggtgtttctggtggtgtagcacaagcatatttgacaatgggtttctgtacttgtatgaagactgttgaaattaccaagcacaagagtgctgctgcaggtgctaagcaatcatcttgggctgccttcaaggaaatttacaacaaggaaggtatcaggggtattaacaagggtgtcaatgctgttgccatcagacaaatgaccaactggggttctcgtttcggtttctctagattggtcgaagaaggtttgagaaaattcactggtaagactaatccagatgataaattaactgcattggaaaagatcttcgcttccgccatcggtggtggtttgtctgcttggaaccaacctatcgaagttatcagagttgagatgcaatctaagaccaatgatccaaacaggccaaaggatttaactgtgggcaaagccttcagatacatttaccaatctaacggtgttaagggtctataccgtggggtcactccaagaattggtttaggtatctggcaaaccgtgtttatggttggttgtggtgacattgcaagagaatttgtcggcaagttgaccggtgaaactccagttgctaagcattaagaaatgtcaaaaaacaaacaaacaaacagaaaacactgtgagataaatcataaacaataataccttagtcttccgcgtcactttgctcataactcataattcataataagatttacatacttagcaagtataatattccccgctgtactcatatttaaaaaaattgatccagtatgttggctatacttttttttgattgagaagtatcgggttgatctgatctgaatcttaactagcggaaactggtcttcatatcgtagcttaataaaaccacgtcaatatatactgtggaaatgatgctcaagttttccagtaaacggcgcgtaatatcagtatttcaattgtatattctaaataacgagtaactactattttacactggaggttccaaataatgattaaactagaaggtttgaggatgaatgttttaagtgaaagaataaatgcatgcaataacaaaaggaattgaaaatgtcgttgttttaatatagtcgcttgagaacatcgtcaaacaggtatgcttataatacagtagtgaaaaaaaaagaagtgcctatagtgaacagtttacttttttgttcccccacttgtcatatccgtacaatccactgatcgttaaaatcaatccgaatagttgattgatcgacaaattcgattcccaaatgaacgctactccgatgatcacgatccgtttcatgatgtttgcaatcgaataagtaacgggacttagcataccgattagttggaatgctaacatggcttggaagaaatgagcaaccccgtgaattagaactagtgtcattacgctcggcgacaaatcagcgaaaactgaggtagagctggaaaaaacttcgttcgatacgaagattgggaaagttaaaataaaaccgacacatgagcaatagaataaaatggtaattttgtccaactggatcggtgagtctttctgggactttagctctactagattcagttgtgatttgttcttacagggtagaacatcttttgacttaactgtcaaaattcctttggcaaaaatgttttgtgatacaaagatcaccatagaaataaaagcaaacgatagacccattgagaaagttgttttatcagtctccgtaagtttgcttttattgttttgggatgtccaacacgtaatgataacaccaaggatcaaaggaataagggtatagtaagtcatattgttatattgtcttccttttgcgaatctataatagcacacggtcgcgattggagataaagctttaacagaatgcaccaaggaaactggaatcaaagatgtggatttatgagaggtaatatgccctacaaattggaaaatacccattgggaaagttgtataccatatgactttagatggtaccaggaaagtgtttaatatgcatctcgaaaatgatccattcaaataagtgggtagaattccttccgggaagtttagaactgtattcttcaattttgatgaagatacctgtggtgcatgcaaatagttagcaaacgttacaaacgcgagacatagcgatgcgcttagaaggaactgcaattccgttaaaccaacaggatgtggaaatcgggataaaatggcttttgacaggtttgatgaaacagaagaagtcatataccatataaggcataaaatagatatgtgaacattcacttccggtaaatactcttgtacatccttgggaaatagattgacaaattgctctttccacgtctgattttgcagtcttctgacctcattgaacgaagttgaatgtttatgagacctgtaattttcctggaacggtatttgtacctggttgacaaagttaacatctgaaaatgttttattgatcgaaggacggcgcttcgaagtgacgctcttggaagttacaatcatttttcgcttattttattcacaccttcttaaaatcaataaagcgagtggaacgaagttgaatgagaataatttagcaaacgatagaatagatcgaaaagaactgttactttatggagcgagcagcgattttagagccgactgtcactatgtaagaagtatctctttctattacaagtcgccaaaaattgatgccatgttattatattatatatttccagtcttttttctttctttctgaccgatgtgatgtttttgcttgctgacgttgttaacgttttttggcagtcacgtggaaagccaagcacaaagggttctctgcagaatggtgctagctcgtgattgctgtgggcagagcaagacaattttctaggaagcgtcaattcaaaatgccataggttttaactctaattactttgaataagtgtgatatgtaaggttctatagtcccaagtatgagtctctttccaattgtttctttctgtccgccattttcttccgttgtctttccaaagtcttcttactggattttgtcccatgccatgcttgagaaagttgtttataggcctctttagttttcaactcattaccctcggaatcctgatatgcgagttcgaccgttgggttgtagtctcttagtttttcctcttgtatacgttgaattttcaatgccatttcttccgcttgcgcagctttaatcttacgcaattcgtcctcagaaaagtttacatcattggagtccaacttttcgtcaacagtcttaagggaattcacaatgccgtttaagatctcaaactctttcctgacatccgttccgtgttttttactgtcgcttcccatattggggcgatcgtcttgcttaattatatttcgttccttcaagaagttcaacattcctgccacacctcctgagaaatcaggttgcgtgatatcgttatcggtgactaatgttgctggaatagttcccgttttatctttttgcactggtttcaaatcgatttttatgggcaaatcatcattaacaggttctctgtcaagaacgttcgccttcaaagaatccaaaaattcatcggtttcatccagaagaattcctttatcactattgttcaacatatgaattcctttgcttctttgctgtccttcgagtttttccaactccaatgaattctttatccctgttatttcctcattactgcgtttctgtttgactttgacaactgcctgaattggccggtctgagaaatcctcatcatcttccaaaagatcaactttcaccattctcgctgtgtctattcttctcggtttctggttttgatttgatttcttctttcgccttttaatcttgactggtgcgtaatcttgatatggttgctcatcatctgagtcactttcaattttgaccctcttagggagagactggtgaacaggtaatggtttatcatttactaaggagtcgtgtaatggtatgtcagatcttgagtttgtatcattagcctcatcgctgtaatcaaagatggagattttgtttagttttctatctttattcaattgccgtagcttaagatttttggcatcctgtttatcatgaactagcttctcattctctaatatgttttcgtcatcaatattctcttcgtcgtttgtcactgaagtttctttcaatgtaaaaatgactgctttctgttcagcaatagatttcagttcatctgatactgggatatggtgatgcgtaatgtcatcatgtacagtagcattttcagcagaagattctttgtgagtgataggtttcccaattttggaaagccagtcatcaatagattctttatcagtagtcgctctttggtccactgcttcctttgattcatatattctttgttttagttgaccaatctttttatcacgatcttgagcgcttccatttatttttccagaagcacaatccttttcggagggacgtgaacttagctgactagatcttcgtactttcctatttgtatcagatgcaccttcttttgattctgttgacgtctcagtgggcctaggtatagtcttcaaacctaaacttgccctaattcgatttgtttcttccaaagatatagaagtaatcttacccatggctttgaagtaactgtatgcctcgtagaattcgtattgtggtcgaatatccttattatcaaatcctgttgctttctttctgcctcatctcatcgccaacttgtccgaatttaagaattgtatatttcaacattttcatcagtgaatattttgatgtaactatcaaagccattgacgatgacaatgagaagaagagtacagcgtatgacaataattcaattattatattttgtttgaatttgatacagactaatttacagaggtacacacatagtatgttcgtatgtaatggaacagatttatacgaggttattagagatttaatgcaaaagagtggggttttaatgtgaatactatatctatttcttttccttcttagatttcttatcctttttttctttcttttccttcttttccttcttttccttcttgtctttcttctccttcttagacttcttagattccttagactcttcatcatcgtctctctttctcttcttatccttcttatccttcttagatttcttttcttccttggtttcttcctcgtcctcggattcatcatcagagtcagcaggagcagcagctgaagacacggtgtcagcatctgcgttgtatgctctagcctctgtgatttcagtcttcttgtgctcacggacgacctttggtgtggttctcaagtctctgccttctaattgggacaatcttgattctaccttagctctggattccaaaccgatgtcaccagaatcgtctctatcttcagccaaagcatcgtaacgcaaagaaacggcagccttagcagccaaaactctggcaatcttacccttgttcttaccagatgcttggccaaccaaggaagcgtggtacaatagaccatatttaggagtgtcatgcttagttttcaatgctctgaaaagagccttttcagcacccaagatttggatggtggaagctggagacttggccaaagagattaaagaaccagagtgtgcgatcaatctagcaccaaccaattcaccaactaattgagtcaaatttggagcaatagccttcattcttgaagacaaatagttagaaagttgttctctgtaggcagcaaattcaacaatttgttcggctaaacacttgatattaatcaaatcaactggggtaatttcagtacccatggagacttcggcagcggtcttgactctctcttcaatttcttcaggcaaaatttcagacatgtcagtttcagcagcattaactctaatacccatggtcaagattattctggcgtaagcaacagaatcagtaacaatcttggccaattctgggaaatgccaaccgtaccattccttacatctcatagcgtaagtgtttaattctttatctagatcgtctagcaaagcaatagcttggatgatcataacatcaactttatcagcagagaacttcaatttgtgacgaccgatggagtgagccaaacccaatgacatcttggaaagatcttgatcgttcaaacctggcaaaagttctggcaagtactccttgactgcacggtaaatatctaaggtgacggcatcagagacaacgttgaagttcaaacccaacttgttgatagcgtttgccaatttagtttcagaaacaactaaggtggcctttttgtcggtcttgcattcttccaacagtttttccaattgggaagagactttaccatcaatcacagagttagcttcttccaaagcatttgcagctgatgaaaatttagagaaagcagcaatcttgaattggttcaagaccttgtcactgctgttcaaatcctgaatcaaagaagaggacttatagatcttcttgtcagatgctttcaaaagagcatacccagctgaggtttctgtcaagacgtaggccatcgctaaaaagtcttttatgtgtatgttgctagatgatcctaattattcaacgggttctttgagatatcgtagatatgatggatgtgcttaattcttcaatcgaaacgttaataccattctgtagttcaatactgatgagatgagcttgtcgaaaatttttcaatgttagttaaatttcaaaaagaaatgaaaagaaaacacatctggacaccacatatataaatcacgtgttataaagggaccagataaagaactgcactgtttgttcttcatatatcgagaccaagcacattccaatggccaatacggttcacaaaagcatcaaactagacgttgtatattaaacaatatttgctggtagtttttaatttattcaagtctatacataaggtgagatgtagaatatatgtgccaaatcaattgacttgtatacaaaaaatgtaggtgtgaaatgtgatcattaactgtcatttcctcccgtctatcttaagttctccggttatagtcaaatattcaaagggattgaatttcatatgcgatcattgaaagtggtacatcatcagtgaggaaggttttgataaaagcctgctcagtgtaaaggtaagaggagggaacacgaaaagtaaaatacaaactaggtaatggtaaatggtgcctctacgcaccgctctcctcaattcttgaaaatgcggatgacagctgtcatgaaaatggcggatagaactggaatagtgaagttatcatcccagttaaacaagtcgataccttcactcaaagctgcgacaaaaccacctaatagcgaaagttgtagtaggtttagtttgcttgtctcttcggtccaggagatttcacctggtttgttcacccagttataatgaggcacaaagaatccgtaaaatgagtaacaagttatgagaccaacggaaaaggctgcaatggaacctgctaaagacttatttctggccaattttggtgtaaggtgtccgtactttctaccgaaagtagacgcagcggtatctgaccaacttagtaagaacagtgagattaacgcgatatctttactaaaaaaggagaacgcaaaagtcaggcccaataagtaccataggactccattatacgtatgaatttcttttttcctcatcaatgccccaacacaacgacaatacattttattgaagaatggagaacgtagacgaatgaagtctaaaataaatacgacagtaaatcctactatcaatggaaatttcactttcttgtaatcaacattttgagtgtaaagatatagggtaataaaaccaatagatgaatggaatagtttccgtggtatttcgtgttttgtaatgaaatcaccaaaccattcatgtgactttaaatgaatttctgttaatggtagatgaacatcactcagactctttcccaagacaactgtttccttctgtttctttgtatttactccgttaggagtactcagtctctgttttaactcggcttcgttgccagaatcatttgaattgtagtcaaccatctattcaaaatagtaaaatgctaggatgttcttctctattggatctcgtcgatttcttttggaatttctgacttcagttcgtatcggaagtgtttcgtatggtggtcaagttccagatcaataatcagaacacaataacgataaccggacaaaccttagtaagacagtagaaactaatgtttaccagtttagttgcagttttgagcacaagttacctattatagatcagttgaagaaaacttgcatcatgatcaatgagttgaaacactgacctcatcaaccgattgcttctttcattaaaatgtttgaatcatttatcgcagattatttatttatcactcgaaaaatcaattcacaagtgaagaagtcacatggcaagtaaacgctatatgttacccgcactaaaatcatcataacatcatttcgtcagaggttccttatggacccactaatcaatgtacagcatcactgtattagtaggaacttctatacttactgtgtatgtatgaaaacaaaatgatggattcttattacttccctataattgacaaattactggtttatacaataaagaaagatatcgtaaatacaaatatactttagtacccagcagtttagtagaaagtggttggtctcttgtaagcgaaaaccttggtagatttttgaactctgtgaggcaatgggaacttcaagtccttggtcaagaattgcttaacgtattgtctcttaacgtcagcagtcttttccaattcgacgacctttaggatgtggatagatctaaatctagctctgtgtctggcagccatgtcttggtacaaagattcgacggcaccaactctggtaacatctctgatttccttgtacatgttgtgagtaccagatctagagtcgtatctaacccagacaccgaagttcttaacggtagttgggtgagcttcgctgataacgtttagagaaacgatttcaccggaagccttcttgaccttgtgcaacttttgcaagaagtaccagtaacgagacttggcaacaacgtcgtttggtgcgaagattctcattctgaacaactttggttcaggaacggattcagtaggtaaacgacgaccgataacttggtattccttgaaagccactattaaaaaataacaataaaatattgttagaacattgttagtaaattaagttcgttgatcatgcggaaaacgtatcattcttgttgaaggagtgataagttttctaatcctcaaatcagatagagttgtcgtgtttggaaagaagtctgagttcaatcaaccaacccttagaagttcgttacgtcccgtttctcaattatgttgtatttcatagccacgctcgcgtgtatgaccgaaatcgggccatatcgtaatgctctttatagaatatatgatttgatgcccgatgttggtttggcccattcgtcttaagtcttcagtatttatgtcttcatcaggccgtttacaacttcaagtgtattaacttctctgaataaactgtaggtttaataacaggcatggttcaccattttctttcgaatgctttcaatcaatacgttattgattacccattattttccattcatattttcattgttgttcatcatattcaaaaactcatgattctctcttgattattctcccatgtacttgtgacgttaactatcgactcgaggatactcttcaagtgttgctgtactcactttttgacggatactgctcttggtggttctgctcttggtggttctgctctttagtgctataacctattaaccaatactatgtgttgaaagttcaatgaaatttctgtatacaattatttgatactttccactaagctgaaagtgctcattgacactctcacccaaacacagagcaggagctaccagagtgatttccagaattggcatccagcacagcgtgcatgagacaaacacaatatccagcccgtagctaggcagaggttagggaagagacgacaccaaagttggtgagagaatagagagggaaaaggatgatcgtgggccagcggcgggaagttagagagaaggagccatgaccccagagggaggaacaatggggggggcttggcccagtgccgctcgctcgagggcaaggcctccctaacacagtcacggtagtacaccacaggcttcccaagttagaaaaataaaaaatgtattcctagttgagtatgttttaagatctattaaaaaaaacaaaatactatactcaaaatgtacggatgtaaacagtcccaatgaatacaatgctgtaggacctcttttcggctgacatcaccctggtttaaggtacatgcagaaattaggcaagaagcatataccctgttaaattaaagagtgagaacaataccaaaacaaaatatccgttaatgtgattagacaatcaaagaaaaaagagagaatatcaaggagttataattcaatattctctcctgcttcatgatcttcaatgcatacatcattccagatacacatcgattcataaacgagtgatgatgataataataataatacttaaaataatctatatatatttattatataagagcaaagtgaagaaaaaaaggacgaacataacatctggactatcaaacagttgagacaacggtgaaaaatatccattggcggtcaatttcctataatgtcattcatcaatttgcttctatcggttcagcatgttgaatctctaaagaaggaacttgttggtcgtttgcttgttctgctacaataccattctcctgttgttcactctctgtaggttcttcagtaatggcagctgcagccgtaacttcatcattggaagtagttcctttttttttgaaacctggaatagaagctaaaggggaaaaagattttatgtaatcaatggtttcctgattcaattcttggaaagaatccttggtggctacccaactttttggcaaagataaatcctcctggttgtccaaatttacgttcaagacatcgttaacatgtttaacgtaattgcatggagccaaaatagtctccttagatcttttattgaaaacagaagcagctctttgaatagcattgaaagttaaggcaaatgacctatccaattcattagagaatccatttgtaggaacttctttaccctcagggaaagaagaattgattaaagattcgtaccatttgttacaaggagaaacaagtggatccaacgaacctctaattaatggctttccgtgagtgtcatagactttttcattgtagtattgtctaaactttaaaatttggttatgggtcggttcataaatgtaattctcagcaaaagacacagttgtgtcaacagttttattcacagccttacttgttagattatatgggatcatagcctcttctccgagtctctgataagtcttggttttcaaactaggaattaccttttctgttacagttaatccagtgtcagcgacagtatccacaatcttagttacaggttccacaaacttgacaggtttggaggtcaaaattgctgtagcagttggtaatgtattagcctttacaactctggcaacagagataccatccaatatttctttagtttgctggactaaaggatatccattgatatgatcaacggtcttgtacgacgtaatttgattttccactggattttgggattcttctgtattttggttatcttcatgtggctgaactgtggtttgttcttcaccagttggttggttgtgtttcttcctgaaaattgacattgcaagatagtattaaagcgctatagttgttgatattttagtgattgtattaagcaatgatagttttgtactagtaataaccaaaatgcagatgagaaatctcttaatggaagcagataagacacagaaatgataagtatggaaagacaacttctcaatattagagatactttattcgccatttatatatttttatttttatgtgtcgatcatggtgtcttgtgtcagttctatcacaatacaataataaattgtttttgtgtctgtttctcacagcaataaggaaacaaagagcacagtacagtatccttctggattttatttcaaacagccgcaattatatctgaatgtcatccctattttgttgatagcacctcggattgccactgacgcgcgtcaaaaaaaaaagcattatcgctctgtcacaaaatgtagtgctttatgtaaaagtcacatgtggtatgctgtactactaaaacggcctacagaaatgactactgggaactagagaagactgtgtaatggtatttgatcatccagatgctaatggatcggtctatctatcaactatttgcgaagctagcttcggatttatgatattatacccatattctccaccgaaaatcagaagaatctgcggctggacgtttgaaaaaacatacaaacggatatcaatacctgttgagatgtgtcaaccgatattaagcgagtcggaaaaggaaaccatagtgatcgttatagtattcggacagtaaaaaaatgagtctagccattctgccatgctattaaatgtttcatggaacattttctgttaagacgttaattcacccgaaacgataatcatgccattatattccgacagattccgtgaacacatgtattctgacacggagtggacaaaaaaaaatgaaataaaatataacggtgatcatgtaactcatgcttattcctgtttatgcaaacaatcagtactattatctcttgtttttgttcatttctggtaaattaccagagccgctattaaaaattactgcaaagtgcgttgcaacgggaagtaatctatttttaagtaaagccgaagctcataacgggccattagaccctgtggtgggaacccgatgaaagggtcgagaagaaactccaacttatcacgtgaagcgcaaatcaaaaaaaaccgttatgatttcctctttcgacaggtattaacatgagcaaaaaaggatctaaatcctagataaagaaataaatgctaacaaatgcttcaacaaatctgcagtcttgatttcctataaaggtaaaatgtaaacaagcgatagtaacgtcgaacaataagatcggaaaaagagcatttaagggaagaggaaagcaccaaggtcattagaacatttgcaaccaacagtgcgaagatcatactgggtgtcaatcctttccattgaaaaagaaataaagtaccttagttttattccttctagatgccaattcctcggaataatgcaccatcttttttatgatgatccaggagtggattttcctaatgtattaaaaaactgagttgcatactacattaggatatcatcagcgttgttagaggtgcatatgatatacaaatatctttaggaccagtccagctgtacacttatatttacaggattgaccaacatagttgtttacgtcttcaactagatttggtcaagcgctctttttttaacatttaattcctacaaagctatggttcattcgagcatgatcgattcaatcatgcattccgatgtcctacctgaaaatttatactagatttataaatatcttagtttttctttcagttgaccaatcaatatttttacctggattggagtgtgtattccacattcatttcagtatttttacccacttaaaaaattgaagggacaatcatatgtaactcaggttactgaaaatctgaaacaggctttccttccatataagttgtgtttactccaacagatcggattgattctattattccgccttacctacttattgccaacacttttagttttaccattttcgaatgttattgtttttcaaaaacatttcttttctgtatttcctccttctcactgcgggaaattaatgaggaatacttgtatttttttagtctcatgcaattcaaatactgcagataaagccgtggcggttcaactctttttgataaaatcacttcagatccttttctttaagctcaaggaattgaccattgaaacagttattctatcgttgtttctacgtgtgatgatccggatgtgtaaacaataatttctgtgtagctgaagtgtttgttgtccttttcagtcttaatatgtgcgtttgtttactttcttgaagatcttcatacgtatatacatgcatgaaagttttcatgatttctcgagacaagattgattatccacttcttagataggtggggtatatgactcttgtctctttatttattacaaataccatcttagaaggcgaatagcctattcgccccatcccaagttattcttctttcattagccacgtatcgtttcttcgtttattattccgttccattctgttttatcttttgatattactaccccggatcaatttccattttccaacagcgtacaaattgtcattatagttggaataactgaatgaagcaagaaatgttgcaaaccccttgtactcccaagcataacattactcgagtggacaatactttgccctttaatggacctagattcggctctaaaccgaaatttcagttcccaccgcagaatacgaattccgaaagtccttgtaaatcacatttcgaaatgatgcgaagtcaacaactactggcaaaccaattggactctaaatataaatccaaagatggtctgaggctttcacctcatatttcaatcccattaatacggactgaggacggggacattgaagacgacgattatgatttcaatggtgatgttgaagatgaactcgagagttgtgaagatgatagtgtagcaagcagtatactctcatcactttcagatattgagtcaccaacaccctcttcctctcctgtatttgatgatacatctttcaggaacgcgttgaaaccaaatgcgatgaagaatgtagttgatccagcgacagtggcaatgtttacattaccacttccaacaaaaataaagtttaaaccaaataaagcactaaagccactcgcatctattcttaagagaaccgcaggtttgaactttatcatgaattcgttgaacggaaattataaagacgcaacgatatttgctacagaagttaactcttatttgtctgaaaatgtaccatatccaacctgcactatagaaagagttacgatacccgtgaattcagaaattaagaggaaatacaaacaagatagaaatgaaatgttgggtggttattataactcaagcgatgaagatcaggataatttggtgtacgaaaggaatgatgacactaatgaacaaaattctaagcaagccaacgataaagcttcttctgatgcagctgtgataagagcatatgatttcaattttgaagatagcaccatactcaataagagtgatagggtcactacacatctgggaatttattcccagaatcaactaatgagccgcaaacaaactccttcaacagcaaaaaaagtcagatggtgtgaattcttagaatggtaactgaggacttcacaagacatccccaacagaggcttaagaaacctttcaattcttcccaattcttaaccctcttccgttattctctcctttctgctagtgattaatcaaaatttggttcctttaccatgaccgtcaataatgaaaagtattgtcgaattaacaaaattgctggcaataccaaataatgatatcagtacagaacgaaactaaaggaagataaaaacactacattgtaaaacttaaaaacataaagccaaaaatattctgaaatatctggcgatgtaataatactaaacaattactcagaaagtaataattctacaaacatactaatcaatttctgaagcccaaataaaagtaaaaataataacaaaatagaagtcatgtcaatagaagcttttgattgatcaccctttttgattttccttatgctaattgttcttaaatagttttgtatttgtattcatatttgtgtattcatattacgacaaatttagttcgagatcttcaatagcagaaaatattgacaaacttatgaagtgacgaggaaatgttactattttgtctaactaaactaaagtgattattaagaaatgtgagtgtataaaaagagttcatgaagatgaacaggatagacctgtcgataacagtcaacttgagagacctgaaaaatctgaaaaaatgatagactagaaatagaaaagaggacaattcttgttttaaaattgagaatgttaataatatgatatgattattatgatagtaatgcattagacttgattactgaagtttgccaacgaatgtcttagctccatctgtttctcagagggggaaaaaaggctaaccaaaaaaaaagtatctattgtagacaagtttcactgttgcactgagcattttcgtcaatggtacatccagtcaagtttgtagttgagccatagacaccaccaccggcaattctgctgaatcgacgggcgatatcttcagtgactgcacctgatccaacgaattctggttgtacagtagcagagtgaataccatatctgtggaagatggacctaataacttgggcaatgttcataaattcttcagggttagattgaatttcaacgtggacagatgcgatgtatagggattcggtcaagttccagatatggaagtcatgaactgatacgacacccggtagagataaaatgtcatgcttaacatcgtcagcagaaacgttagatggagtagcctgtaacaagattctagaagccttcagcgataaaggaatagcgcttgagaaaatgatcagagaaatcaataacgacacagcaggatcagtatagaatctccaagagaaatctgtcttccagatgaacaatgccgttgcaatgacaccaacgttacccaacgcatcacctaaaacatgtaaaaagacaccgtgcatgttcatagaacgttgctttgatttcttttgcttcttgaccttggccagagttttgttcaagtgctgttcggttaacaatccagtggattcatcgtcttcgtcgtcgtaagaagaatctacaggagtagatttaggggaaaaagttctttcaacgatagaatgaggcatcatatcttcgatggtctctggttcgtagtcgctaccttcatctaatccattagtctggtgagaatgaccatggctgtgaccatgaccatgttcgttgtcatcatcttcttcttcaccgtgttccaaatccggagcacctccatggctatgaccatgcccatgaccaccgtcactatggaataaagctaacccaataaagttagaaactaaaccgaaacaaccaacgattaacacaagtttagggttggtaatctcttgcggctggaagaatctttgaatagcttcaatcaagatggaaacacaaagagcaattaagaaaacggcgttcactaaagcacctaaaatttcagctcttttccaaccgtaagtgtacttagcatccggattcttattcttggcaacgttaaccgcccataatgcaatgacaagagagataatatcgtttaacatatggaaagaatcagcaatcaaagccaacgaatgaaccatataaccggaaatcaactcgatgaagaaaaaggtagtatcgatgaccaataaggtcactatcctcgcctccttaccacttagcatacttacagtgtttttacttcttgtatgctataacccagtggtcttgtattctgtattacaaccttactaatgtcttttgattgtgtaaccttgaacctggagatagaaacagtataatcctttaatgaaattccaacggctgcaaaaataaagcttattttgtatggaaaagaaaatgacaagagcaccgagaaaaaagacaagaaaatccttgtccgaacaaagagcatagagcactaggtatcagtatagcaagttttcctcatcattttgtttttttatttagacgttctgtcaaaaagaaactttgttctgaaggttaccttacctttatttcagaccaagagcaagagcagtgggcattggtggttttaggctaattcttagtcgaatctatacgatgcaacgccgttgaggaggtggactttacacacaaattagatgaattctatagggcaatgggaaaaagagagtgtgatgaaggaaaaagaaacttccagatgagggacaatacacaaagttggtcaccgagaagttaagctgaaaaggtacctaccggtgccaaaaaaaaaaagcttggtgtcctagacactgaaaaatcgtgctggtgagattatattgagtttctcttggacttaactccatacaattttaatgccactggacagtttaataaagctcaacattcttcttccaatctaagcttcaatctttagtcgatgacttctgtctgcgtggcttttccaatatttttccgatccatcaacatctagtctgtgcccatctagggccacacggaagttcttttcttttgtgacctaatccgggtaaaccaatagaattagcgtatttgtttctcaccagcgttttcttatgaatggaatgtctgggtgtctggaacaactcttttttttctcctgggtattcaagcaaattacataatcgttgggtacaggttacttttttactttgttcggtgtggattatgtaactcgaaaacaatttttctttccgagtcatgttctttctttcttcctttctttcttttcatttgctgtccggcgtcagagctactgacagttgagtcttcgacctgaacatccgatagatattaggtaataaatagctgttaatgcatcagtatgaaccatacagcgttcggtaaaccgcatactacgcccttttagttaaaagaaagaatgacatgagaatgtgtgaattatgttgtgcgcttttatacaatgatcaagcaccatatcttaagttctagaacggatcaaagagtgcactgctaacgaccatcatttggacgaactacttggtttccatgatggcagtgtagtaacgatggaagtctttcctattggaataagagcaatcttgtttcttcttttgagcgtagctgctttgctggagtctcggaaagatatttcatcaattcaaataatccaaagttctagctatctctcgtgtatataaactgtccaaatcatcgatagtaagcttttccagttcacgtttcgaagagtaatattcgataaattgtcctgagatcaacgcaaacagcagtaacacaaatatttattggagtttttcgatatgccaagtgtcaaatttatagttttgctgtgcgttttgccagtgttcttcagccagggctcatgtaaggactcggattcataccataatgtgcattctcttaagcatgccaaggcacagggaaaacaaattgaaggtaaagaagtcgcacatttattccgtagagggggtacttgcaaattccccaacggagacggaatggtagcggtgcaaaccagtgggaaaaatgcgggatgggccatgcataatgaccaagaatgttcatatggatcgtggtgtccatatgcatgtgaatcaggacaattgatgaaccaatgggatcccgaagtcacttcgtatacctacccaggttcccagtacggtggattatactgtgacgacagtggtaacttgcagaaaaagagaagcggtggctactgttacgaaggtaaaggaacagtcgtcgcaaataacaaggcaggttcaggtgttgccttttgtcaaactgtcttaccaggtaatgaagaaatgatgattccaactttagttgatggaggttcccaagaaactttggcagttcctggtactgaatattgggcgggtactgccgctcattactacatcaaccctccaggcactagtgtcagtgatggttgtcaatggggatctacggcaaaggccattggtaactgggcaccttatgtggccggtgctaacatggatgacagcaaaaatacatttgtgaaaatcggttggaatcctgtctacttggaatcaggctcacctttcaagaacacaaagcctagctttggtgtcaaaatcacttgtgatgatgaatctaattgtgaagggttgccttgcagtatcgatccatctaaacaggatgttaatgaagttgaatcgaatgaaaagtctaccggtgacggcgcaactttctgtgtcgtaactgcgaagaacggagccaaagcaaatatcgaagtgttcgaaagcggtagtagcagccagaaaaagagagaacatcacgcccacagggaaaacgtgcagacaacaacagagtataagacagttacagtgaaagtttaaaatggataggtaaagaaatgtctcccaaacatgattatagtttgtccgtcaagtactattcttcattctgataaatgagataacaaaccaaatcccccatgttagaataaaaaaataaaggagtagaaatgtgggcccatcaatgtatttattgccttttctagttgccttcatttccttcttttcaaatagttttcagttcttgttttagttttctaaatgttaacatgtatgtattagtgaaaatgcttaaccgaatattcaataagaagaagttttggcaatatgccgtcagcgattcacgccacgcccttcgaatatatcatagatcattgctaaataaggatatttaaagggtactaatagaagaagtttatatacagttaggaagaattccagttaaagcctaacggaaaacgtcattgttaaaataaatacatgccggaaaacattatcaaatgagttcacaggaagagaaagaattttctataggggtacgtgtttgtacttaaaaggagtgaaaataacttcgcacaaagaaagaaatccctatcggatcatttttgctgttcctccatttctttcaggaatttttccctcttaaaatcgacgactcttttctctttaaaatagcttatccagctagtagcacagtcttgttcaaactttgcctcttcggcagagcacgacgccttgatagccttctgatgctttggatcaagtgcgttaacaacactaatcttatctagacatccgaagaacaaatctctagactcccagcattgtttcctagacgatcttgaaggtgcctttgtaggatcatccatttccttttgcttgctaaaccaacccattttctcgctgtttattcgtatctaaaactccgttgctgttttaatgtgacaagaaaactcactgacgatagataagtagttcgtaatgcaaagatttgcaacttttccttaacaattatctgaattctaacttacagagttacagaaattcacatttcagtgtttcgatattgttggatgcagcgaaaaggaaaattaagtctagatcacgtgctttggatcagacacaaaatagccttacgactgaggtaatgtgatgaaattgaactgctagaggtttggcttgttttgaaaatccgaccccataagaagtttagtctagtgagcaacctgtcactatcagataagatgatactcatttctgaggtccaattgactttacttttgtgaatcaggagcgtgtttattagggaaatcgaaatacttcaatgtttaaattcagattacttttttttttatttatataaggaagctccacattgtagatcgacaacgtagccaaaacttcaaattagagatgggaaacacacactcatagcgcctataagaccattgctaaacgctaccagcactctgaaataggttacattattttgtgactttaaattttctgttctgttagaattatattaggaataaaggcggtaagtgtttagttcctttttttgctgagagtattctctttcggttgatagattttgcaatgagtttggaatgggaagacactgcttttgatatggcttcattgtccttcatttctgatctgaaccagagtaaattgaaacgagtcattgttgccaatgctttacagaacgaggatttggcgagtttagaacatttgggtacttccagatttgggtttgtaaattcgcaattgcgaagtcaggcatggttgagtattttgcagtccagagtcaaagggtcacacgcatgcgggtcgttgaaagagccgcataaggacgaatatcaagtgaacttagacgtgaatagatcattttcttttattaaagattcttcagaaaaattacaattaagggatctgctctatgatacgattgtgaaaactttaagaaagttcccacagttaaattattaccagggatatcatgaggttgtgtcagtttttgtactagtctgtgaccgtgattctttgaatgaaacagtagaactttttacattactatatctcagagattatatgatggactctctacagtgtactttggaacaactcgaagtattaagtcaatttatcatggaaagagatgctgacttagcgaaaatcttacaattgaaccagaaaaagcccatatttgccattgcttccgttttgaccttattaattcacaatttcgaaaactttgaagaagacagccctattttttcaatctttgatatcgtaataacgaccaataatttatctaatctgttcgtcgtttatacagaactgttaatttattttaaggtgccaattttaaaacaagtggaggcttatgaaattgattttgagaatgacatggacctgatacattctgtagtacaacaaactttgctgaaatttctaacccgatcatcatgggatgaaatattaacccaggcaagactacggctaaacaatagtacggttagagtggcaaaatatgtcaacaaatacagtagtttgatatctgtatccaatattgagttctctgaattaataaacgttctttcaaaagaaatagaatgggacgcttcaaggaaaatcgtcaaagcgtcaccaaagattccactatttgttaaatggtctctcgttataggcataattgcggctgtaatcaaggtgggttcttcacataccaacactatacatagttcttcgttgatagattctttgaaaaaggtgctaagtccgtaataagtccgtttagttgccttccgtgtaatgatacagatatatttaacatgtatttattttatacaggttaccgaatacttataacactgcttcatcaaatgtttaatttagttcaatatcatagattaaagttacatcggtcgctgtaccttgccagcctcggttaccacttgtactaatcatgaatctacatgtaggatccacataaagatttgagatacatccaccatgatgtcctggaataataagtggggttttatcgatatggttaatatcaaagattctgatgttatcgttagatgccgcaacaacgtggctattgttaggcattgccttcactttagaaacgggtcctgaaattgatggcaattttaatttgctttccactacctcgggctttcttaaatcatatatttctacaacagcatttcttctacctgctattactttacccccgtctactgaccaacatgcagacatgcaccatggcggtgttgaaacattacgaccaagtttgataatttcgctcgagggttgtcttcgatcccagatttgaatattaccatcaatgcaagacgtcaaaaataagttttcatccgttttcaaagctaaagtattcttactaatggtttctgattcgaccttcttttctgatgtgtgttcttgtatctcatttttatctttgttttcttgttgagtattatcttcagctttctcggtattatcgttggtagctacgtgttgatcatcctgatcatcatcatcatcatcatcaccaaacaatgaattagtatcaacatcatcgatatcagctgcatctccgttgccaactacattattgctatcgacatcaggattgtgtccactcaagttaggctcaggaagttcgtaggcggcattggtgggtctgaattctaatgaagacaactgtgatgtagcattgaacttggttatatcagttcctgtttccaaatcccattcaatgacggttttgtcccaagaacccgataaaaacctagtttcctcatcattaagtacaagatggttaacgatggatttatgacctttaaaatagtgtgcagtcctcccttcaaaatatctaacaccctgcattacgataccgccagtttcttgtccggctagtatgaacaaacattcattttgaaccgccaaggagtggacaggtgagacgagaggaagatactccgacttttgttttacccattttacttttgacggaggttgcggtacttcattctcccaataagaagtcaagatacccgcattgacaattgaatccaccaatgcgttcttctgctgaatagttagtgatagcttaccatccacagtatttaagaagtcaaacttccttataaacccgtctgacccaccgagaaatagataccgtagacccttggacatggtcaatgcctgtacattagtctgtattggtattgctgcagttggaagtatattataagattctgctacagatgcagatctataaagagtcgtataatattgatgtatcttatccagctttgacatttcagtagatttcccatctgaagaagatggagaatccttctcagaagttgcggattccttttcggcactctcggcatcatcatctccaatttcgtgggtattagattgtttaatttcccccgttctcgtgccctcttcaccattctctgtctgttcttcatcttcttcctcgtcatcatcgtcatcatcgtcatcactgcgttcatcatcatcatcatcatcatcatcatcatcctcacttcgatcttcagcatcttcgtcatcgctccgatcttcatcctcatcgtcgtcatcatcggcatcttcagcatcttcatcttgttcttcctcgtccatcggctcgtcctcttcggcgttcggaacatccacatctacatcctccaattcatcgtccatgtcaacatcatcatcttgagtattttgaacgttattttgattcaagatttcatccacatcatcatccatattggaacgtggcttaggtgggaaaggacaatgttttgttgtgatgtgttacagtgtttcctgtcatattcactgtgtcctaaattcgtacagacaggtttattttggttgaaatcatttcaatatcaacagttttattttccaaatatcaaattgaatcagaacactttcaaatggagacaacaagataacgatcctattatacactggcggagcttctaatcaccgctcaatcggtatctaactatagaacaagtcactcaaacctttgaaaactacaagccaaaacaaataatggcctcgaacgacctagcagtggaagtgcacgatctaacgtacgcattccccggaagtaaacgctcagcaatccacgatctatcgctaagtgtcgaatggaacaagaaagtcttagtggtgggtaacaacggtgctggaaaatctacgctgttgaaactactaagtggtaaacatttgtgtctcggtgggaacataaaagttggaaacaagaacccattcgcaccaaacaatgaccaggagtccgtgatactgactacttacttaggcactgaatgggctagtatggctattgtacacagggatataggagtcctggaactcttggagagtatcggactaagccactacagggctcgaggtgaagagctagtgagaatcttggaagtggatatcaattggagaatgttcaaacttagcgatggccaaaagagacgtgtacaactgtgcatgggtttattgaaacccttcaaagttctgctattagacgaagtcactgtggacttggatgtcgtggcacgtgaccgtctattccaattcctggatcgagaaacgagagacagacaatgtagcgttgtgtatgcaacgcacattttcgatgggctagcaccatgggctgatgagattatccatttgcaagatggcaccatcacaagaacgttggattaccaacgtgatatccactttacaaaggaaatagagggcgtccaagagcgaaaggacaacggacgacacaccgtgatactaggctacatgaagagtttatacccgcttgcactccactggttgaccagagaccaagtcgaagaccaaaagctttgattcaacttctaaacggtcaaaccgatatatgtctgtaatatactatatatacataatcagactttaatcatacacaaagcgaaagataaatcacgtgagtaatatatcggtccattgcctaggttccctcccttcctcgtttaaaaaacgtaatgctgccaatcgtataacgtcgtttacgggatttcgcctcgagggaacgaaaagaatgaaaagcataatacgaagcgaataaaaaaaaacagttaggaaaccccagaaactgccgtaccagaaaggaaactgggtggtgctgaaatgtgcatcaaagcccaactggcgacagaaaaacaggccacaacttgcgaaaagtacgccgtaaacactctagaagaaaagagctagtcgtatagactagctgtgataacggtatgaacggcttggtttcgcaagccaatgcttattgaagaaatggaccgatgaggctcgatactcttcgcattctatcgttaaaactcgggttttttatcgttcaatttggttaacttcgtgaaaaaaaagttaaaaatgaaatcgtgatattttctatacacactgatatataaataatatatgtatataaggcgatgagttagccagtttgatttagttgctagattcagatcgtaaaagcagcaggaataagtcggcatatagaagcaaaacacagtagagggagaatcccaagctgatatacatatattcgaatacacaccatggatttattattggaagtttgtgatacgtatctgttggattacgtttatgggaaagtattccctgtgaatatgctacccagcagtgttaccaatagtgttggtcagtttttggacttgaacacaggaaatttaaacggcactgcagccaagccagctggtgatgtgtacggttatgaaccattcttgttggaattcactgattatacgttccaatcaattttccctcgttataatttgtttagagaaacgctaacgatgtttgtcttgatgacaatttttggatgggctttgtacttcagtgtcgctacgatgtcgtaccttttcgtttttgataaggctgttttcaatcatccccgttatttgaagaaccagatgtcgttggaaatgaaacaggcattcagtgccatcccagtgatggttctgttgactataccatggttcttgttcgaattgaacggatattcgaagctttacctcgatatcgattataaatcatgggctggaattcgtcaacttgcgtttgaagtgatctctttcatcatgttcaccgattgtttgatttatttggttcatagatggttgcactggcctagagtttacagggctttgcacaagcctcatcacaaatggttggttaccactccatatgcgtcgcatgcgttccacccagtggacggttacatgcaatctgtgccataccatctttacccaatgattttcccattgcaaaaaatttcatatttgattcttttcaccttcgttaacttctggactgtaatgatccacgacggtgaatatctggctaatgaccctgtcattaacggtgctgcttgccacactgtgcaccatctatatttcaactacaactacggacaattcactaccctatgggatagattgggtggttcttacagagaaccagatcaagaacttttcaacaaatctttgaagaagagcaaacaaacttgggaaatccaagtcgaaaagatggaggccatcaaacaagaagtagaaggtgactgtgatgacagagtttacgtcacaaccaaagcttcttaggttaattgtaagtcgctctttctcgattcaagactcttcactccactttgcatgcatttgcacaccataacgaactacattcaagactgtaactactcgttttcttttctgttatgattatgactactttttttttctcctactcacaataaacacatgtccttcgtacgatatctcatttcccctctctcggatacctgttaccaattgaatttccatctcttcccttttagttaattgatgtctgtcttcgttggatcaaactttccccatttttatgtatctatatatacatcttacttacttgtacaattatagaaccttcaacatacgtgtttttattttagtaattatagtgattccttgcgatactacaaaatgctacaccttttccttgtcttttgtcgtccttgtcttttgtcgtccttccttcatttatcacattaatgacataaaacggaaattatagattagttctaatctcttcggacatgaaactgaaccattgggtttgtcactgacaagactaggggtatagcgtactaacctacattggctacatgacaaacaagacaaatatgacaactccaattaagattcaaacaggttgcgctgatttagaattgtttcctgacattgtggtgaaacggatagatcttgagttgcaaagacctcctcataatgcacatactgagttagaaattttgaaaacactatcaaataagcatgtgatacccttgctcggttctgaaacctcaccaaggtatgttacattcaaattcaaacggtatcaatgcgatttaaaccagttcatggaccaacattggaaggcgaaatacaatccgtacttgttagataattctacaaaaacatattcaaataccataccactcgatcactcgacagtgattataagacaaataatcgagggattagtttatatacacggtaatggcattatacatagggatgtcaaaccgcagaatatcatgcttaactcgtacaatgaagtcgtattaggggacttcggtataagttacaataggaatctggataatgaggccaagacctgtgattgttccacatcaatttacaaagcaccagagcttctctttagcgtgtcaaattacaaattcgagatagatatttgggcattagctgtgttgatttctcaactctggaacgataaaacacaatccaaatcaaaaagcagcaaagtgatagacattgatttcgacgaatgttctgacataaaacttgtgctcactttatttgataagtttgggaaacccagtaacgaggattggcctcaggtgactaaaaatgaatcattcaatgggatgttcgggaatgtttcaagcgataatttcttgcataggagaccaattgacgaacaactgattcaagtgtacaaatggatgcctctcataacggacaacccaaaattagctaagatgtggctacgcatggtcaaattcgatggtaatctgagaatatcggcagagcaactcttggtatctatctagtagtgtttctttgtagctccataaaatgttgaacctgctttaatctttgtatctctttcttctgaactaacatctgtcttttcatctcgttcaattcgacagatggtgtgctaactttcttctcggtatccatatttaaaacttcggcggggtgacaacaataccggttgtcagaaatttcatttgaatccattggcagtttccctcgatttattgtccttgagtggactattgtgaccttgagagatgagatcaaaatccgttttcaaattagaaaaacatacaagcacgatattggattcacgaaatagataagttataaactacttcatgtctatcccattagctagacctacgatctcacaggaacattaacacataggagaggactatgtttctaaggttactcctccatacatggaggaaatgccgatcaatcctgcttttgctcattactgcaagcgttttattctactatacctttgaaaatgagattgagcatcttaattcttttgcatacactgattctttaccattgattcagaaccaagattcgcataatgctcctgtagctggttctgcagataaaattacacacgatgaaatatccaaggagctgaccgataagtcgagtttgtctgaaaagaataagtatttccccatattgctagagaatagcgacgaagccttgaagtatcggtcggaaaattatgacagtaaggagccattccaccccttccatcctttctatgagaaaaaaactgttataccttacaaacaaattagcaaacagtatccgcaattgaatcgagtgtcatctattcattcgaacgctttaataaaggacgagctattgtatcattggacagctagaataaaccgcattacagaccatgcctacttggatttgcaaacaaatatttccattttgtctacggactcacttttacagcgaaatgaatcacttcttaccgtgaccgctgtacttaataagtttgatgacccaatggatcaacgggtctggtcatctgagattttaggttcattattagctgtaattggtaataggaaagagaagaatcctgaattgttacagttgataacgataataggtgaaatgttgctccgcagttacgacactccaaactatttaccgcagattcctttcttttggaaaacatctgtcccaaatcgatacgctttcaaaaagacaaaaactagcatgttagcaactaatatacttgagtttcttactttgtcacacataactaatgacccacaatttgactcagttgtttctcactctttgcagacgatgtcaagatccgtgcttttattcgatatagattaccttttcccttcctttgttgacgcaagtggttgtaaacctttatctgatgaaaaaattgcaaaaggagaccaccttcgtgaatccaacgttttgaagtctatgcaaaatggtaagtatattcattgtgttatcaaggaatcgctacttcctcaacataatgtcgatggaaatcccattacactggatacaatcgatttatacttgaccgttttgaaggcttatcatcttaataacggtaatctgtttgagaaaagagaggctgaaaagtctatcactaaatcgttgttacactcaattaagatgataaatgacacaatgctatttcagccgtggcttccatctgatttagaggatcttttgcttccaaccagtattaaaacaaacattcatttcgacgttttagaggatagaaacgaagtctctatcgggaaagaatacaaggtgacgccagatggtgctaaaatgagttcacttttatccatatctagcgttttgtttaatgattcatcattgatcgagcaagcaaaggctatcactaaggggtattacgaattatacaagttgttagatcaaattccagatgttgtggcattggatagaaaacttcctactttcggaatgtttgatccaactgctaagattgcgctaatcaaatctggacactataaatcaaacaccatgcagcaaggcgtcaaaattacggaaacgacagaagacaaatcaaaacactatacgaacacggatgcgcacagcttctcacccaacgtcaaagacataaatgaagaacaattgtgttggaagctgcatacttggccgttttatgtcaatgatatggtggtatcaacaaggccacctttcgaactcattgagtcgttaatttatctttacaaaataaccgaagactatcaatggaagctcatcggtgaagatcttatgcatagcatcgaatggtcacaattaaccgtagcggatacgggaaagttagtaaggttattttatgcattgtttgaggatcacgttaatattgatgaatacgtcataaacagcaagtaccatttcattgccagacaatttgaggttaatccgacttctaaacggatttatcatacctttgacgacataaaagaaaccaacaagctaatgaacccgtaaatatgtatatattcgcatttgttatagcaagaatgatcatgattattttgttgaatatgattcaattgttgaattgaactacttaaaaaatatacgaaaagagatgctatttatacatatcatcaattagataaaagagataccatttgttgaaaattagaacccaagttgataaaaaagagtgtgaattgcaattggtattacggatcatcaatttgttggatgtccataagaattgaaataggatagtcattattacagtgtggaaaggaaagaaaacaagtgtctgtcaaatattttttaatccaagttcgtttacactggcaatgggaattcaccggcccattggtagatttcgttcttcaattgggtcaattcttcagaaccttcgttgaccttagccttgaagtccttcaatttgttggcttcctttggcaaagattgttgagtcttagcagcaaattgaacggccttgtcaatgtagtcgacgattctagcgaattctggttcaccgaaacctctagtagtcatagctggagcaccgatacggacaccacctgggaccaaagcagatttgtcacctgggatagagttcttgttcaaagcgatgttgatgttttcacaaacgtattcgacacgagcaccatcgacacccttttctctcaaggagactaagaccatatgggagtcagtaccatcggacactaatctgtaacccaacttcttgaaggactcttctagaaccttagcgttcttcaagacttgagtttggtactccttgaattctggagtgttggcttgcttcaaagcagtagccaaggcagagatggtatggttgtgtggaccaccttggtgacctgggaagacggagaagttgattggaccttccaaatcgtatgggatttccttaccagtctttgggttaacagatctgatacctcttctgaagaagatcatagcacctcttggaccacgcaaggacttgtgagtagtggtagtgacaatgtcagcgtattcgaatggagatggaataacaccagcagcgatcaaaccagagatgtgagccatgtcaaccatcaagtaagcaccaaccttgtcggcgatttctctcattctcttgtagtcgatcaaacgacagtatgcagaagtaccagcaaccaagatctttggtctgtacaagatggcattcttttccaaagtgtcatagtcgatgataccagtctttggatcaactctgtatgggaaagattcgaagtaagtggagacagcagaaatctttctgttttcagtttggtaaccgtgagacaaatgaccaccatctggcaagaacaaacccatcaatctttcatgaggtctcatcaaggcttggtagacttgcaagttagctggagaaccagacaaagtttggacgttaacaccccatttgtcagcagtcaagttgaaagcttctagagctctcttttgacacaacaattccatacggtcaatgtgttcgttaccaccatagtatctagcacctggataaccttcagaatacttgttacacattggagttcccaaagcatcgaaaacagaggtagaggtgaagttttcagaagcaatcaagacaatagagtgcttttgtctgtcaatttcatccttgatgatttgttcgacttctggatcactttcagacaagtgagcagaaaccaagttcttgtgagagtcagatagagcgtatggcatcgttagattattatagttgttggttctatccttaatgaagagtagcttggaagagaagaaatactataaacctctaaaacaaaacgaataacaaggattccaagataaaacacaattagataaatggtagtccaatatatatacttgtacacgtttccctctatcaggtatccttcatatttataacgaataaaggatttcgtaagaacttaatttttttttttttttcaattaaaatttcacagtaacttgatcaaagaattatgataattctgaaaaagaaaattactacgtaaataaaatcatcgtaagtactttcagtactgacagtaaccttattacttacccgttgtaagatagaattagcttggattggaacctgtgaaaaaaatttgggactgttacttatgtcactgctgctctgctgcgcaacggcagtaatagtaccttcaagtcatcggaaaaaaaaacacagtgatggttatgtaggagcactacacatagttgcatacatttgtgtataaatttcgtggcccacaaaatagtagtgaaatgagtcgtgataatacgggcctttgtatccaatatatgacttgaatggagctggagcggtgatacacacattttgagagccaccactgcatttcttgttcctttttttttcacttttcacttctcgagatgagcttccatttttgacttgaaaaggttcgacagtagacttgacgaagaagaggcatggcattggcataaagagtttgacttgagtgagggaaggagtatacagatcgttatatacaaacaggatggatttccctagattaaatagattccttgattgcttcgaataccttgtcgatgtggtgcaagttgtcatcgatggcagagatacccatgtgaccaattcggatatacttgtccttgatgccgggtaagattccaccggcgatgactataccctttgatttcaaggaagagatcactttacctggttggtcgacgtatacggcagtcaatccatgagcgctgttggaatcctctgagaccaaagtgagacccaattgtttcaagttatttttgaactggtcagaagttttcttgttcttggcgattctggcctcgagtccataggacaagatttctccaagggagacgtttaatgcgttaactaattgaattgatggagtagcgaaatattggcctacaccagcttcgtatgctttcatgattgggatccatttctttaagttagcatagaatccatgggtggattcgttgctcaaagcgtatgataaggcgcgttcactgatcaaagaaacacttaacccagaaggacatgataacgccttttgagatgcggtcaaaacgaaatcgacagaccattcggagaatttaaattcttcgcatccaatggaacaaacaccgtcaacaataatgaaagtttctggagaaactttcttcaccaacgaggtgattgatgggagatccaatagggtagcagtagaggtatcgacgtgagtcaaagtgatcaattggtatttcttggactttaattgagattcaattttgtctaacgcaacgactttacctggttcgctctttaacacatcgacatcagcaccgtacgttttcaaacattcagcaaatgaatctgagaagaatccggtagaaattgtcaacgctgagtctccggactttaacaagttgttaccgacgatatcccatcctagggtaccggaaccagaaatgacaataggttggtcaccagcattacttgtttggaaaactgttctcaacttttgcaacgccccttgaaagatcttaacaaattctggagaggtatgagccaacgattgaatgctggcggcttcctcgacagccgaagacaccataattggacctggaattaataataaatctgacatggcttttttgttttattttctggggttctatgagtctttatgcttaagtctatttttttttgcccaactcttgcttgatccgctttgacaatctatctaacttagttggtataacggcttctgttattagttatatttctttgcctcttgcctggcaaaactttaaagcgacttgctcaaaagagacttttttaactgttccacatttaaatgagtctttcggtcttttcttaatattggagcgcaatcggatcaagaaaaaaaggttagtatgattcggagaagaccgattaaaggaccgacggaagagaagacaggataaagcaagatagaggtagtcatgtgacgaagtagattatatcattctgttccaaaaacaaaagaatatctttctgctatttagtgatactcaacagtcgctgcgtaaggatgaacgcgcgccacattaaatacataagatacagagagatacatatatacttatcttaaaataaaataatatcgtggattgtcgaatgtcatgatatgctgtcatacaagcactctgattcggctggaattgttgaatggaagccatataatagtagtacccattgtaaaaaaagattgaatagtagtagaaaacaaaaagaagatccgaaaatgatataagaataaaggtaagaaaaggggaaaccaatgttaaacttcatgagaggcctccgtcacctctcgagtgtctggtctaatccataagatcgtcaaagtccacggctaacatacttgactgcgcttcgggcagagaagtaaaaaatactcgcatatacaatgtaaagacatcacgcttgtgatattatctcttaacatttggcaaaaacacacacacaggtgtttgacccttgaaaagggcaaactgggaaagaagagaaatgagagaggaataaaggagcttgtattagctgtgagacggctagatttgactgattattgactggatacaacgtggtgatcatgtctcttctcttctttcgcataagtgtctgtgtcctggtatatgctgagtatcgtatacttttcatgttacaatcactgctggattgcgccatgtgtcaaggccgattggacttattatatctgatggttcaagttcagacaagtcggagtttagttcaggaggtaccgtcaacaagaggttccaaccttcgccagtttcctggtttctcatatctatatttttgttgtcgctgttggtaccatcttcagcgatgaaggaaattcccacatcgtttagatcagcatcgccattattttctaaaagcatcgaatggtcttcttcgagctttaccacaggagtagatgatagttggtaattctgttgtcccaagatgtaattcaaagaattgttatcttcgtcaagcataccattgtcagttaccattccatgcggtagattcgaaggagaagaagaggatgaagaactacttattgatgtcgaatgacttgaatgagaataatggtccttcttatcaggactagacgttagactctctggagagtctagcatcccggtgttactgtcatgagaagaaatacttccagaatcactgacttgcatttctctccattgttcaaccatcccgctaagcttcgcgttattctcactcaaaatatccaaatcaaccattttcaaaatgccttccaatagatgacatttctcttccaaccgttgcacatgcaaacgtttcttctcacgagattgatgtgcagccctacggttacgcaaaattctctcgatccttctctgctccttctcttcctgagtctttgcccgtttccttggtggtaatgtgggcttaaagttcactggaatatcactcacgctgttttttcctgtcataatgaatttgtaatatcttagcttcttatttatcagtctctaaccgtctcacaggttgtttatcccaatacaagttattttgtctctgagggtggaagatacttaaaaaatatataagatgagcaatagtacattcttaaagctatcgaaacatggattaagaacacatcatcatattcaatctccttatatactttttctcacctgaaaccaaaccgttaaaaaagatctttgaaaatctttcgcttccaccccaggtcgttaggatcaggatacgtgggtcattgcgactgccaggaaaaagccacctacacagaagttgacgtaggaaaacagtggccaaaaacggtttcagttcttttgatattctataagggttatttttggacatgttttccgggtaatagaaacgttgacacgtgatgtctattctattttcgtgccttgtccactgtacttttgacatcttcagagacatttatgagcatattatatgtatgtacgatcatctggctgatgttatgacattattgctgctgtcatctgcagaatcaagtttgattttcttctcgggttgggacgaagtttctaattcgggatttccctcggaatctctcttgttatcttctttttccttcgcattctcagcttctctttgtatctcagccttccttctgtcaacgaattctttcgtttcggtgtcatttttgaaataatggttttcgtagaacttcaattgttcaatactctccaggatatccgccttggctgtgtgtgcgccctttttcttgtacgtaacgcttgctagttgtgggttatgcctgcgcgccacttccatgatactagatacatcgataatcctatagaacaaatgatcaatcactttcgggaactcgttcaacatgaataatcggtccatgtgtaccgaatttccggctagcacaccttgtctctggtctggaatccatttcttgatataatttaatagctcttcctccacttgttctctagtctttaccgaatccagtactttttgagttagaccgctaaatccatgctggttgatacaccattcgttcatgttgtccatgatggatttatcgtaatggattacactctcgtacccatcttcgtcagcgacgtttagttgtccatctgtgatgatacaacatacttcgatgattttgtcattgatatggtcaagtccagtcatttcacaatcgatccatacgataggttgcttcaacgcacccggtatcagagctgcaggaggattcagcgtcgtgtcattgtttgaatcgtgtaaagtagtcattattgtcgtaggttggctccaaattggacgttttttcaagtatgggttgtagaaccgccttgttggtagtagaatacgttggcgtaacctggttccaattcctgtgaacatccaaagtttgatctctttgttcaccaaaattttatagtcctagtggatttgctggactaaatggtgcaattatggattgtgtgtcctgattcaaatggtgaatagattacaacttatatcctccactctgtctaagattatgagattctaactgttaaactgtctcctgtagattcccaattccgtttgcccatcttgtttcttggatctatgtatctctctaatgtcaatttttcaatttgcttaatttcaatatacaaaagtgaaaggaaggaattattgaacttgtacctaaggatttcaggatgattttgaatctattacaagtaagtggtaccgcatagtacaaattgattcaaattcgcgctcctatttgttgccaaatcgattctcggtgctttgcaggtaaaatcaccttggtttgcttcaaagtaggcagattaaaagaagtattatccagcattttttgaaggggactccgtcttttagttttttgtgcgatccaccttggtttcgctagacgtattgttatcataatttcccactctattgatcgtctccattctcattccgctttatagcttacttttatcctttcgattgtgcctcccgaaatattttgctcaactaaaaggtaatatatcaaataatggaacaagattctgacgaggcaatctctgtctcgtcttctaattacgacaaatatttgagattagccaccgataaaaaccctagtatacttttagaacttgacttacagggaaatgttaaacaccttagcaaagtatggaacaccgtcataggaaccaatagacttaagatcttggggaatccagtctcaaacatcatcataggaagcgattatgataagtctgttttccatcgtgccttgaatatgatgcttgaagatgataatagttatagagtcaaatttctgacggaaaccggcgatttaatgggtgatacagatcaattggggttgtcgagctctccttctaaatcctccgattcttcttctgtgagttcaagtagtgacgaaatcaatgctgaaactattagaaacgataacaatgagcttatagatgcagaatggcacggaaatggggataccatagaattagaagcgcaaggaatcttaatacatgatatttataccaaaaaaccatcgcacactatgtggatagtaaaacctctttatgatattgatgagttagataatttgccgtatgatttggtaaagagattaggatttggggcaaaacttttctcccaatatttgcagaagatagaagatatgatgatcctagacgagatggatcttcccactcctaatttcgaattatgtcgagtttgtgaagttatggttcctacatggtggctcgaaactcactctcagatttgcgtttgtgagcacagactagaaagtgtggtgcaaactgcacacgacgagctactagaacagaaaggtttaatcgaatcgattattggatcattagaagaacaagagtaccctcccattacagaatataagaattatccactaccccaaattaatagtaggggaagatcaccaagtccgccattccatgaatcgaatggatcctatcggtcatcttcaatggaaagatcaagttcctcactgctgaaatcatctactaatattatgcagcaaaacatgagattcccatttaaaccgctatatatgttgaaagagctatgtgaagaggcaattcaagtcaatacaagccagttgaaaatgcaatctgaagaaatatacaataatggtattctgcacccaacttcaacattctatcaattttccccaaatactgaattgcatattgatcatgttttgaattggaaatcttcatttgaagtttcagatcctgccataaatttattgatacaggacaccatggctatatgtagacagaaggtcgaaactgtcataagaatggacaacactctcaaatattcacacaaagtaaagaatgaggtggatttgtcaatttcacaattaatcaaagaaaggattcacagcaatcgattgaatgtttcttacactttagatctagtgccgaatatcaattcgggaccaggctcagctgttaatctaggaacaccttcatcaccaaaattagccacccctcttccacaacggctaccatcatccagtaacctattctctgattcttatattggcaccgacactattccagaacctcatccatttggcaaatcaaatgctgacattgcaagatcttactttgaaaactccggttcaaattctgcacatgcatctaaatctgtaactcctaaacaatcagtaggagagcaagattctaagataactactgatgatatttcaatgggcgaaggattggaaacttctatggatagccgatctaatccttctactcctaagtttgccctgaacaattattttcatcttcccaaattaacaagtagtatcagtctcactcctcgaagaggatcacctgtaaacttctctactcctacctcgtatactcagaatggtgctcaaatcaatccaaattatttttcttccgccaatatcatgggttcgttatccactacgaagtcgatcactgacaattcgccgatgctctcgcccttcatttccggttctgaagcaatgcaactatctgatagtaatcaacatcgcaatcaacctctttcaccgctactgcttccaaccacaggtaaatcgattattccttcgatacgagactacgatgtgattaaacccatcagtaagggcgcctatgggagtgtctaccttgctaaaaagcgtgtcactggagagtattttgctatcaaggtactcaagaaatcagatatgatcgccaagaatcaggtaacgaatgtcaaatcggaacgcgcaataatgatggttcagagtgataagccatatgttgctagattatatgcaacgtttcaaaacaaagagaatttatttttggtgatgcagtacttgagcggaggagatatggctactttaattaaaatgatgggtaatttgccagaaaaatgggcaaagcagtatatttgtgaagtgatctcaggtgttgatgacatgcatcaaaatggtatcattcaccatgatttgaaaccagacaatttgttgattgattctttaggtcatatcaaattgacagactttgggttgtcacgtatgggtcttttgcgtcgtcataaagagaagaggcgtaacagccaaattcaaagttcaagaaatcccagtttcacttgtgatagctctgtgacgcgtaaaaattctgtcacagattcattacaatccgtaccgggcgcggctgagaatatttatgacttagtcaaaaagactaaaggtcccaatcatcctctagcgcacattcacaatctccatcaactgttaccgacgtaccttatttgaaaagaaatggttcccacgtttcatttacaatggctggtctttcacgctccggcacgcctcccttatctgcaactttgatgtcaacatcagatcatctaagtattcccaaccaaaatcatcaccatcattccaggacaaactcaaacctttctgagaccaatgtccacgattcgcctaaggatttgtctttattcaatcccaatgaatctaagaatttttttggaactccagactatctcgcgccagaaactataaagggtactggcgaaagtgatacttgtgattggtggtccgttgggtgcatattttttgagtttttgtttggatatcccccatttcatggtacaacagtagatgaagtcttcgaaaatataattggtggtgtcatacgctggccagaattccctgatgcggagacagaaatggaatacatatcaccagatgcaaaagatttggtaattaagttattggtgcttgatccgaacaagagacttggtgccagtggctctcaggagatcaaagagcatccgtacttcaaagatgttgattgggaccatgtgtatgacgagcaaccatcatttgtaccacgagtggaacatcctgaagacactgagtacttcgatttacgtggagcgtctctcgatgaatttgctgcttcgaatttcgatgaagataatgattatacgatgctagacgccaaaaatggtacaaaatcactcgactctcagttacatcggagactgtctgaccaaagcagtggtagaaacactccaaaacaaagattaagtataagttctgttcttgaaatggtgaaccaaaacttagaatcaccaaccgcgaacaattcaccgattacaaaacatataccgctcgctatccctccacacatgagagacagacgtagtagcaaattgaacgactcctctccagaattcggctcctttaactacagaaacttaaatgctttagataaagccaataaagatgcaatcactaggttgaaatcggaacatctgtcggagtacctccaccagagaacttcaagttcgtctttatctagctcttcttcggaaaactcaggtaagctgaaacaatcaagtgctaatagtgcacagggatcagtcccaacctctatgggtacacgtagatctaactctcctcaagtactgaaatggaatacgaatgcttctccaagcaggcgcaacagtgtcgacaccatgagccctcaaccgtcagcgactaaaagattttcggacataggatcatatctaactgaagaatctgctcacgggagttcttcgacgtcatctccgttagcatcaaaattcaagtctccactatcaccaccatcagtaaacggcactctgggttcaatttcaaaatcacggaaagtatcaagaaatagtttcggttctacaacggaggatgatgagagactctccgcattatcaagggtaaacaccgtcagaaagctcagacgacgtagtgggcggaaatcttcttccaactcgaacggtattagatacaagttggatgtcttactctgtgaacctattccaattcatagatacagagtagcagaagacttggaaagcattgggtgctctgttgtttccgctggaaatggtgaagagttggttcgtcgtgccacaacaggcgtaaagtttgacctaatcatcacagcaatgaaacttccaaaattaggcgcaatcgatatagcaaaacttataagacataccaatagtgtcaattgcacgacaccaatagtagccttaacagtctattatcacgacgccaaagaatctaaggtgtttgatgatgtcttggaaaaacctgtaagcgtggaacagttacggaaacttgtgtccaaatatgcgctacttaagtcacaaaacgaagaagacacgcttctgagtgacacagaatcttgaacagcgaatagacttcgaactcacgaattgtcctaaatatatatatatatatatatatatatttatactagtcaatgcatacatacatatacacactctcttttattgtgaaagctatggatataggaaccttattgataattataatgaatttgacgtagtccttctgcagcattcaaaaaaaataaaaaataaaataaagggaaaactcagatttaaggaaagaatgcacagaaccaccccttaaagaatgatatacttaccgaaggtgtcaggaagatacacacacacacaccagagagctatcagcacaatcgagtcctaagcggttgtagcagcaagtgtgttacatacaggaataattgatacaagctattataattgccgctgtttctttgcttcttttttaatcatcaagttcccttatttgacgctcagattcactacacttttggtcatataacgtttaataagagagcagcaacaaattactaaaagcaaatatacatcattcatttgatagtcttttcttcactacatttgcaaagctatagtttcccttttaaaacaaacaagaagtgtctgttttcagttaatgattcttactttttattggaacttagaacacattattgattgcttctctactgtaagacagctggattgatagttacagtgagaaatttgccaattggacacacgtattcctttttatcgttttgtttaacgctgaaaatccttcgcaaagcttccccagagtacccccaattaatcgtactctagatattcccaagtttaaaatagtcaagtatcctctggtaaaccctttccatttactagatttacgtattgcagaggcaaaaaaagaagaattcttcgaatcgttctaagcgtcttttagcctctcttttttaaatctacaaaataacagcattattatttgcatcgctatttgttagagccagctcaactgttacatttctgacgctcgtaaagtgctttactgtaccccgtcaaccgttctcacgtgaagtgcctgcagttttctacccacaaatcaatcgatttttccttcttttatcaagaaaatcgtgaaatcgtcgaattctgatttttttcttccaaagaaaagttttaggaaatcggaaacattaaagttttctagttaaaaaagtgtaaagaaggaaaaagggttcttccttgaagttaaaacaccgttgacacggtaccttacaatcgtctttgagaattcaagtgttcccaagcacagtaattgttggtgagctcgtcacaatacacgttaatagcaagttttaagtgcgaattttgggttttacttctattcccctttctcaaaatcagatttccctacagttgaaagaaaactgaaaagaaaaagatctgattgcgtatacttatctgttactgtagtctggtggccaattccagtgtacatcttttgtttcgacttggtttaaaccttttgttttatttctgaaaagcagtttagctgggatcagttgttttatctgtattggacgcgtgtgttttattagattcctcgataggaagcgttggtaagagatatgtcacagcacgggttcgatttcaagttcagtcaatgctttggtgataaagcagatatcgtggttacagaggcagacattataacggcgtcggagttcgatcatacaggtgattatcttgcaaccggtgatagaggtggacgtgtagttttatttgaaaggaacaatacaaagcattgcgaatacaagtttctaacggaatttcagtcacacgatgcagaattcgattatttgaaatctttagagattgaggagaagattaatcagatcaagtggtgtcggccaacgaaccaatcgcatttcttgttaagtacaaacgataagacgattaagttgtggaagatatatgagaaaaatatcaaattggttagtgataacaatctatcagagggaaataaagactaccacagacgctctgctgggaacggtagcgcaagagctgtactgtctttgcagactttgaagttacccaagctgtccttacatgatagaattatagctgctgcaccaaagaagatttatagtaatgctcacacctatcacatcaattcgatatcgttgaattcagatcaggaaacgttcatcagttcagatgatttgagaatcaacttatggaatttagatataccggacgaatcattcaatattgttgatattaaaccagccaacatggaggaactaacagaagtcattacaagtgcagaattccatcctcaacagtgtaatgctttcatgtattcttcatcgaaggggaccatcaaattatgcgacatgagacagaatgctctttgtgattaccgagctaaggtgttcgaagaataccttgacccaataagtcataattttttcacagaaatcacttcatcaatatctgacgtcaaattcagtcctgatggtcgttatattgcatctcgtgattatttaaccgttaagatatgggatattaacatggataataagccattgaaaacgataaatatccatgaacaactagaagaaagattaaatgatacttatgaaaatgatgctatattcgataaattcgaagttgctttcagtggtgatagttcaagtgtaatgacaggatcatacaacaataactttatgatttatcccaacgtagtaaaaacgggcgattatcaagcacctactggaatggatgaaattgtattacaagcagataagactgcatttaaatcaaagaggttgagtagtttgcaacagcaaagtgcgagaaataaagaatggggtgatgaaattgatttcaaaaaatccattctgcatttctcttggcatccaagagaaaatagtgttgccattgcagccactaataatttgttcatcttctcggcattgtaattttactcctcatcaagttgtaatcaatagtgttacagtttgccattttacatacgtatatccatatgtacatataatctctaattttctcgtcgaattaaataacatatcgaaggtaaactaatagctcggggcatagcttcaagtgtgctccggatatattctggatatatgttgtatatacgctgtaccagcgtatcacttttcgttttccccttattttttgttcggttaacaatggggaacaatgtaaagttaaagtttttggaacgtaaagtcagtttgtattcatcattcgtgaaaaaaaagtaagtattgagttactaaagacgtttgccataacgctgagcatatcgaagttgatgtactgcttgtcacagattcagtacaatagatattgataatgaagaaacttatatctacttatgatcattgacacagtgtgacgtgttttattctatttttctaggactgaatttacaataaagataaaaagtgtgtttattcttcttgagttaaataataattatttgtatggtggaaactccactataaagtttatccatatgtttgttgtattttgaagtataatgccagattaaacggatgtttgaattcttttgaagataatttgaggatatttgataaaaggtgttttaaaagataaaaaaacccacaggcaggggctatcttgatatttcattatgaatggccaaagcccaacaagttgagatcatttatcgaactgtgtttaatcgtgagagacgtgtctgttaatgactgggttccagaacaaagtcttgtcaccgtcaccccagaagaaaggcttttgtcttaagttttggaattcgtagtctcttggccattcttcatctggaacgtgcttcaaatgttcacggtgctcagcgtgttcagcttcaacgaagtaggtgttgacagcggtcagagcaatagctggagcagcaacaaatatggagatcttaacccacaagttagaggtttgcttagcgtgctcagtactgtgcttcatgtagtccttgtaagcttgggcagcagccaaatctggcttaccgaaagctggttccaaagcatactttggtagagtagaagctcttctaatggcttgtttgaacatttttgattatatctagggtctggcttttcgaaacagaatatccttatggaattaattcaccaaacacagttgacgttaaatagatatcaaactcgaaatgaatgtaaaatgaattgtaaacagtaagaaaactaatcacaaaaatctcttttaaaaaagtactttgacttaccaataaaaccttttctattatggaaagagtagctttaataacttgaactttcctaactattaaacaattttttttttcctacctccaaaattttctagcatcaacacaatctctctcgcgatatttccatatcccactccatataaaaaaccaaaaatggcacgacggagaaactagacaaagatcatgctttttcgatgttgtaatttcggtatcacattacacggtatgaaaatgattggttgctggtcacgagagacttaagttctggtaatggacactgagcataaaaggttcctattccttgtttaaatggtgttgctgtctcgccgggactacaaacccacaagtagctcatacgataccgttcacactggcaacagattcagaagtacttcctactttattttctgtttctgttgcatctctttatacatattgacaaacagtgtaatattgacgttcaggaattcaagtccgggtaacaatatttgtttcacggcctggcggtaattgattttgggtttttagcaaacctgagccatcgcatgtcattctagtagctgctgcagggacttgccggctggggttggtgtagtggacagaaacaccgttcctaatatatagaatgctagattaagctgagagcttgttgcattgaattcaaaaaacaagcgcgttggctaatagaacgcccgtaggatcagccatggttatggaaatcaaaagattgcctattgctgcttaagtgtagcacgaacttgtgggtaatgtaacgtttgtaattacaagggcgtatgacataaattaaaaaaaagaagaaaagtaagaaggaacacatacagactcctaatggatactgtgtatcgacaaataaaagctaggacatttgaagtaaagagagtattacatctttagtttgtctttgaattctttgatttttccatgaatctttcgtatttccttttcacatccacttcatggatagatgagcctgtcacttgatttcctatcgtgaaccatccaggacggatgttatggtccctaccgaaaatttcaagtttacgggcatgtgtaccgacaagtctttcaatgattccatacaattcgtccggctttctactggtttctctagttgcgctaatgatcaagtcaatgtctatttttctgtttagccattccggattgcctttgaccccgacgagtaaatgctctttactgtggttcaaccaatggccagttctacctgtcacaattgttcttcctaattggtttgtcttgatccaagatatttcatttattacttcgtaaccccaattctgcaatgattctttccctacttcgatagcacggccggttacccacaagaacaataaaccttcttcctgcaagagatcaaatggtagttgcagtaactcattatcattgcaagtaccgtagggcaaattcatatgaatgttccatgcgggatctgcaataacggctgaaaatttaccaagaatatcgaagtcaaactttctgacgtcacatttgatccattgtggaggaagaagcttcttaaacgatgaagaacagcactctccatgcgtatagaacgaatactgcttgcgttgctctttttgttcttcaattttctgtttttggagagattcaggataatattgcagatagtggacgtatctgcaggtacttaacttgtgacaagtatccaaatacgaacaatctcccaacgaaagatccgtctgtggctttaaatttggtatgaaatgaatgtgcgtgttcgaacattcgataatatccggacaatcagcttcaatcttctttaatttttcaccttgcaaagacatgattttgttgttaacagtattgatgacggtggatagtagtgacacatgtttcggatctgagcatattggtatgaaaggtgatcgcttagtgtttaattttgcctgttctttagataacttagtggatccgagttctaacgagaggatttgatttaagtgtcttagacacttagcattaggggttacaatttcactctggtccaaaatgcccatcaacttatttaataatatgggttcgctttcaatttttctttctttaacctgaacagaatctttatcgatcgcaatctgcttggctttattgccagtatgtgataatgacaatttaatagcttggtcataatgaactttttgcaatattttcaaggagtccccatcaacaaatgaaatcttttggccaaaaatattcccgccactatcatcttcaaaattcatgcaaccaccacatacttctgaaattttattcaaatcttcacaaaactggtaatacgtctcaccacattcgttattcttccataggaaattttgcatgaacatggaataaatgacataaatgtcgtgtaagctaccattgatcggggatgcagtgatggacgcatagttgtccaacataaaatcaactaacccccaattcaaagacataataccagtttcactcctttcactgctcggacaatttctttcgagacgcagctatattcagtttcgtttcaccttgttactccactcaataaaaaaacaaccgccgacgtcaatatctctggctccagacaagatataacaaatccgtatatttttttcgatcaccacaactttcacaaactttctgtgcctacaatgtcatgaaactatatataaattgccggcttttcctctcagttccatccacgtttaacaatggttctgtcttaaaaagatggtgtatttcgtgatgaagctgggattttttattttcaaatccgagtttgatctaggtaggaattcgttgtgaacaggggaatacacaggctccaaactggcaggaaagtgaagggctttaccagtgtattatacgtgaatctgcaacgatgctgatctctctttagaattgtggggtacatccttcatcttgatacgttgttatcacgtgattggttcatgtgatgtacggagtttatggttctgatccacttggaataaaaaaacatggaatttgaaaatacagtaataacagaacaacacataaataaagtacggaaaggtcgaatagacaatcgaccgagccaatacccaactctttgcagattgtagctaccaagtatcaattctggctgagtggcagttattcattacgggtaagtggtagcggaatccttttcataagatgtcatcggatacacttaaatttgatgagaaaacggaagctgagaagccattgtttgattgtgattttgggacttcctatagtcccagagtctcgtaccacttcaattcgaaggtatcacaatatcattacggtgtcaagcatccaatgaaaccttttaggcttatgcttaccgaccatttggtttcggcatacgggttacacaaagtgatggacttatatgagacgaggtcagcaacaaaggatgagttaacaaaatttcattctgaggactatgtcaatttcttagcgaaggtaacaccagatacattgaataaacttcctcgagggtcactcgagaaattcaacattggtgacgattgtcctatcttccaaggaatgtttgattatgctgccttatatgctggggcatcgttagatgcttctagaaagctacttaatggtcagagtgaaatagctatcaattggtctggtggtctacatcatgcgaaaaagaacaatccatctggtttctgttacgttaacgatatcgtgttagccatagtaaatctactgcggtatcacccgagagtgttatacatcgatatagatttgcaccatggtgacggtgtacaggaagcgttttacactactgaccgtgtgttcactgtttcattccataagtataacggcgaattctttccaggtacaggtgatttggatgagataggttgctccagaggtaagcattttgcattgaacgttccgttacaagatgggatcgaagacgactcatacattaatttattcaaaagcattattgatcccgtaataacatcttttcggcccagtgtaattattcagcaatgtggtgccgactcccttggccacgatagacttggctgttttaacttaaatatcaaggctcatggtgaatgtgtacggtttgtcaagtcgtttggagtaccaatgcttgtggttggaggtggtggttatacaccaagaaatgtttcaagattgtggacgtatgaaacaggattattaaatggggtattgctacaacctaaacttccagaaggtattccatttagagattggtttggcccagattattcattacatccaacactagatgacttgtatgaaaacaaaaattccaagaaatttcttgaaaatatacggattagatgtttggagaacatcaaatacttacagggtgccccaagtgttcgtatggatgcagaactcatcccaacacaggacatcactggcctaactgaagaagaagaggaactgataaaagagttaaatgtcgaagaggacaaggctaggttggcacaaatggagaaggatgactttaaagtgggcgaactatactaaaatatcacgtgcggaaatctgatatatttgtttttttttctttcttttggttacgctttgtaaatagatatcctatatggagttgttagaatactactaaattaacactattaaggtaaaattatgagcacgaagaaagtgccttcgaggttaaataaatacattattaccaattaatattaagatcgtatacttcattatgcttacatggtatgggtttttatttaacttgtctatatgtgttaagaaattttctgaagatatcctttagtaaatagaatatctttaaattgctgtgaatattaaataataatggcggatggaggtacaaaaggtattgttttgaagtaccatcataattttgtaaattgtcgaaaacttttgagaatagtcttcatcaaacgaagagtacttttttgtcagtctactgggattttgaaatcaaacaaaaaaagcgtctccttaaacaccagcttcgaagtccttttgagccatgaaaatggataaatcaaccactcttgaagagtaaccatattcattatcataccaagaaaggaccttgaaaaaatggtcgttcaattcaataccggccttggcatcaacaatagatgaacgtgaatcggatgtgaagtcagaggacacaacggcgtctttggtaacacccaaaacacccttcatatcgctgcgagatctttgttctagggccttcataatgtcatcgtaagaagttttctttgctgtacggaatgtcaagtcaaccagggaaatattaattgttgggactcttatagacataccggtgatcttaccattaagttcaggcaagattttccctacagccttagctgcaccagtagatgaaggaatgatatttccctggcaagatctaccgcctctccagtccttaccaccagaactggtaccatcgacagtcttttgagaagcagtagttgcatgaatagttgtcatcaaggcttcttcgataccgaactcatcgtccaaagccttaaccaacggagccaaacagttggtagtacaggaggcattagagaccacgtgatccgtcaatgggttgtatttaacgtggttaacaccatagacgtacattggcgcggtctttgatggagcagtaatgataacttttttgacacctttatgtctagaggctgtatcgacttccttgaagacaccggttgagtcaattacataatcgacgttgtaggaagcccatgggatacgctctggttccctaaaatgagatagagggatatgagccgaaacatggtcattttgaatgatgatacgttcatcgtcgaattcaacttcaccacgatacttgccgtgagtagaatcgtatttgaacaaataagcagcgtattctggtgttgtggatggattattgattaatctgaccttaacttctgggtgcgtcaaagcagcacgtagaaccaatctaccgattctaccaaaaccattgataccaatgttaatttgagctggcttagaagaagattcgtttgtcatatcgggcatctaaaaaagtgacagtatcaattctgtgagattttaaaaggtccggtttaaagaaaaaaagtaacttttctctcaaataataataatagcggtaatatgtgccagtaaatattagaaaataaagaagttttctaatgtcaatgttattaaatcacaagtggatgacctagcgtagcagtaccagtaagatctttatttcttaaaaaaggtaaaaagaagaaaacggtgatgcgaaagcagtgaaagcagagcagacagcggttaattagatatgattatctctggatttgtataatttaaggaaaccatcaaccaaaaaaaaaaacaccagtcgtttaccggttagatgatttcgtcttaaattgcccatggcatgtacatcccatatttatatatacttgaggataacagataaatgaatgaaatagaagccatagagaaaccccggaagaatgtttcaaactggtctaaatatttgaaaggttgaaattccaacctgcttctctgtggcagaggaacgttgagaaaaaaacacaagacaagtaaataaaaaggtcaaattcacaacaaaaaaacgccagaaaaactacgtaaaatgaaaggctttttttcgctgctgcttccgtgcgattttctacgccaatccctattgaataatactaggacagcgaagcatcggtcggttattgattgcttctatgtggctgtctgccctatcttgagtcacgaatcagagacaaggggaaaccactacatcaattagacgccagataagaatagagacagacgctttaatgagcttactggccaataggaagcgtttttggtcatcagattgtatgcctattatgttgtccggtctctggtagataatgtcataagtatgccgaagctttagtatgaaaaaatactgaaaaaactccggggttcgtgacagttttttagggacaaaaaagtcctaccggagcaaattggaagagacagacaatttggccctgaaacaattcggagtttcaagaaaagagggaaaaacagagaaacgcataaagagcagacatgatttggtaatagttccggggtgaggggcacagtagatactgcagataaaagggtcttcttcttatcctcctttcttagatatgtacatagatatacctttatcgaatctgcctagagaacccgggggagctgtgaaagcgatgttttccgggcaggggctggtgcttttgagaacggttcagagtcgggcttggaaccgaatcttccgggtactgaattcttggaaggttcggaagaggaagaagcacacacgtgactcaaaacttgtagcgccagtctattgctcgcttcccagacagctcttgtgctgctagctatatggggggtgatggtgttataatggcaatcctcagataaccattgttctacaattggctcatcgtgaaacacgtccattgctacatgtctaactctgccgggttcttgtgccataatatgctgtaatgcatcatcgtcgattattgagcctcttccgacgttacagataacaacgccgaacttgcatcttgacagaaaagttttgttgatcatgtgatgtgttgatgcatttcctggtagacatattacaatgcaatcaaacgtttcaaggcatggactgcttccatgcgcatcctgaaaatcagactcaagtagctcagagattggatggaattgccacttctggatataagtgtccgagcttatttgttcttttgtaaccggatttctctgcgtgtaatgtatttccattcctaatccggaatccaatttcctaccacactggattccaatacgtccaagtcccataatgagacatctcttgttccgacaactttcattaaaggttcctcgtttccatctgtgcccaaattcgaaccttggtgaattgttttcaccgtgttccagtacgatttctgaacgagccttgatagtgtttcttgctgatctcaatgcatgtgcctgacttgagaatttccgaaacccatctagaacgtgccagaggacgcaatctgcaacgtcgttggctacaattccagagtcctgtatcatgtcgtcataattgtacagttgaatgcccttttcccgtagtgacttcaggtcgagccaattgtaacctacagaacacagacatatgcacttgatcgacccaggccaacgatgatcatccaagatttctgcactcaaaccacctaagggagcgaattgtggataccctccaaatattccgacaattggacccttttgcttcgaatgctggtccaagaaagttagaaatgcttccttaccagtgccatcaacatctcgttcaagtgtgtaattaaccgtgttgaactctttttgcaaaagcttatattcctgtaaactgtattcaggttcagctatgaatagtatccatggcctgtccatcgtgaaacgaagtttgggacaaatgagggaatatggttttgtgtataaactttgcagtgaagggatccgagtttttctctgccaacccaggatcgtctttgttataattaatattgaaacctccgttcacagatctgggtcacgtgaagaaaacttcagtcactattttacgatattggttgaactgacatactacctttcgaggtgctgaacattcctggatcttcagcaatttatgagcatctgaaattgtccaactagtttgttaacgctcgagatcaatgcctgaactgaatgcagttatatgcgtctagaacgtttgtcttttaaccttgaattagtgttgaaaataaagaaagtgcgattgttacaataaaaataacaataatagggaggatcatagtatttagcaagaaaacaataacgacttcaaacgtagggctaccttcaactagataggaaacgttggacctagttcatagaacgtcgaattgacaaaagcttgtaataatggacgaaaattatgatgttatcgtccttgggacaggtcttaccgagtgtatattatctggcttactctcaatcgaggggaaaaaagtcttacatgttgacagacaggaccattatggtggtgaatcatccagtgtcacattaacgcaactatactctaaattcaaacaacatcctttgagtaaggaagacattgagtcaaagtttggcaaggatagagattggaacgtggatttgattcctaagttcttgatggcgaatggtgaattgactaacattttggttcatactgacgtcaccagatatatcgagttcaagcaagttgctggctcgtacgtttacaacagaggtaaagtatataaagttcctgctaacgaaatggaggctatttcatcttctttattgggtatcttcgagaaaagaaggatgaagaagttcttggaatggatcagtgcatacaatgaagaagatatcgccacacatcagggcttaaacttggatcaaaacactatggatgaggtatactacaaatttggcttaggaaattcaaccagagaatttattggacacgcaatggccctttggaccaatgacgattatctgcaacaacctgctagaccatcagtggaaagaattatcctatatgtgcaatcgatttccaggtttggtaaatctccatatatttaccctatgtatgggttgggcgaattgcctcaaggatttgctagattatcagctatttacggtgggacatacatgctaaataccccaattgaaaaggttttatactcagacgatggtaaattcgaaggtattgtcaccaaagaaggtactgcaaaagcaccaatagtcatcgcagatccaacatacttccctgagaaatgtaaaactacaggtgaaaaggtgatcagagcaatttgcatcactaaacaacctgttcctaacactagtaatgctgattcttgccaaataattataccacaatcacaagttggaagaaagaacgacatttatattgctactgtctctgacgcccataaagttacttcgaagggtcattacctcgccagtgtatcaaccatcattgaaactgataaacctcatatcgaattagagccggctttcaaaatgttgggcccaattgaggagaggttcatgggtatttcagaaatctttgaaccgatcgaagatggcactaaagacaacatttacatctctaaatcttacgattcctcatctcacttcgaatccatgaccgacgatgtcaaggatatctactttaggattactggtcacccccttgttttaaagaagagagaagatgttgcagaggagtaagtgagaactacgagataaccgtgatgctaacttttgaaaatatcgtaccttcacgtacttctacgtacttttacgttactttcttgtttcgttacaatctttatcattatcattttatttttgtctatttactatctagccccacatattagcttgaatgttttggcaatagttttatttcagcaatcgacgtaaaaatatcccagctagtcctcttaagtccagcagcttctctacttctacatatgaagttgtgtatgtcaattttgtacatgtatcttttttttttccttcaacatgaaattgtttaaaacaatttcatgttgaaatttgacaatacaactacaacacattcaaaagtcaaatgcatggacctctgaaccaaggccgtactgtccagaaccatgctattattttcatttttcaagaccctggttgatcatgaagtcaaagtcgaactaaagaacggtattgaactaacaggtactctaaaatcagtcgaccaatttttgaacttaaaattagacaacatttcgtccaacaataatgaaaaatatccacatctatcaagcgtgaggaacatgttcatcagaggttctactgtgaggtatgtacatttgaagaaatctatggtggataccaacctacttcaagatgcaaccagaagagaattaatgagtgaaagaaagtaaacgaaagaagcagcgaaaaacagggttcctgctgcagaaaggaataatttataactgttaaatatcattcgagtctaccactctcacactattcacatatgtaataatagaacacattacctatcatggtggaactcccaagagtttcttctcacattttgatcggaggtgtccagtttcattgcaataagaacatttaatgttgttagctttagactttcgttttccaaatttggcttgtttaggagttctttgtactggaattagagcatattcttgaccgtctttctgaataatctcaatttgtttcgaaatcatttttgagaacttctctttatccagttcaacggatgtaatcatcgagatgagctcatcaacgttcttcagtttgttctcgtattcctcttttaaagacgggagagtcgactgctttttttgggactgagataacactagtttggctagttgatcaagcgcctcagactgtttaataatcttgtctgcatccgccatgatagagcttgtggtcactggggttatccgataccacacttcctactctggtggtcctgaatttgatcctatctctctatcgttcttttttcacttagattccatagtgaaagtgaaaataaaaaacgacatcggacagggacggatgtgaccccgtgagaagaggtggagtcgcatttccttacgactatatgctcatttcaacatacgagatatacatatataccatgcaactatttttaggttgatttgtcttactatcacaaacttttctttgttcttgaacagaactgccctttacgaggcgtaattaatagtttgcgattccaatttcacatcagcagggttcggagccgcctcatacactgcaacaattggaactcctgaatttcttagtttccctgtcgcttcacctcttaactcacagaaatataatctattaaggtcatcctcatcacccgaccagttatccttcactaagacagtcaagttctcacaattctggaagatattccttggcaagtcaaacttgataaatgtgtcatcatcaaataatgattcattattataatctggttcaataccgacgttgtctggaaactcgacggtgtactccgccttcagatcgtttatggtatcaaagtccaaattcttattgtagttcttatacaactgaatgtgtcttggtgtactataccctgatccacccttgttaactcgtaatataattgcaaatattttaacagatgcagtaaagggaatctgaagtaacacttgacagtctgcgtctgactctaagtaaagggaagtattatacttctcatcttgcggcttcaaaaagctttttgaaaccaaacttgacctatcattgctaactccattcaggacttgtacttttgtcatgtcaatatgtgtatatagggactggttagagaacgtttctgcaggtggttcatgagaatgtccatgatcgtggttatgaccatgtccgtgatcatcgccatgactgtgaccgtggtcatggttatgagaatgcaactcgtcttcacaactgaagcctgacattgtggttatatagacagataacttttgctcttgttattctattctggccattacattcactttttaaaccatcctatctcatctcatcaaatcacatgaaattcttactattaaataccttaatctgtaaatgagagttacaggagaaataagggtatagacataaaagctaaactgagatacgtataattagaaacaaaaacactcaatgttacctgatccttttttagaatacccccgtaagcatttcgtgttctgatacccgtcggtctggcatctatcgttaagtacttcggcagatccataatatgaataaattcattatccaatacaacaaaaaataactaacacaattcaaaagttctatagtttgaagaaccaaaccaccagcaacctaaataaaataaagacggcagcctgtgtgcaagtgcatttttgaatacctaaactgtatttactcataaagaaccaacttaaaacatgccaagcacgtgatacaaaaataaaggattcttactagtcattcccaaaaaaaaaagaaatttccgagcctatctgaaaaaggtttataagtaactcagtcccaatatccgcatcaaaagcagcaacatttcttttactgaaggtgtattctgtccagatccgaagagggaagcaccgccctaaagatagtacattcacttgtgtacatacatccaaaccaaaatggtccatgttgctagattcttggacgaacgtcctaccgatattccttctattcttgccggtggttataaccatcctttattgagagaatggcagaatgagagacagttaacaaagaatatgttcatcttcccgttgttcgttagtgatcaggatgatgaggaaactattataccatcattgccaaatatcaagagatttggtattaacagattaaaagattatgtcgccgggttggttgccaagggtctacgttctgttattttattcggagtgcctttgaaggacggagctaaggaccaagttgctacttctgctgatgatccagaaggacctgtaatccaagctatcaagttacttcgtaaagaattccctgatttgtacattatctgcgatgtttgtttgtgtgaatacactagccatggccattgtggtgtcttgtatgaagatggcaccattaacagagaaaaatcggttcaaagaattgctgccgttgctgtcaattatgccattgctggtgctcattgtgtggcgccaagtgatatgattgatggtaggatcagagagattaagatgggattgatcgagcatggattggctcataagacctttgtgatgagttattccgctaaattcagtggtaacttgtatggtccattcagagatgccgcttgttctcaaccaggaaaaggtgatcgtaagtgctatcaattgccttcaggaggtcgtggcctagctagacgtgctttaaagagagatttgcaagaaggatcagatggtatcatcgtcaaaccttctactttctatttggatgtgatgtccgatgcagctgaaatctgtcgcgacctcccagtgtgtgcttaccatgtcagtggtgaatacgctatgttacatgctgctgcagagaagggtgttgttgatttgaaaagtattgcctttgaatcgcactatgggttcctcagagctggtgctcgcttaatcatcagttacttcactccagaatttttggaatggcttgacgaaaattgaaaaaagaagccactcactcatctacgaatcataactccatacctttattcatattctaatgaccatggcatgttctaggacacaatcttttgttattttcttctttcctcatagccctctttcctattgcgaaatcataatacgcactgcctaattaaagggtacatgccaaagtataatttcccattcctgtaaatctaaatgtaaaatggtttgtatatattattaattaattgaatgaatgaaataatacagaaacttcaacaaccagctagaaatgcaagacgcaaaatactgttgtattcacaaagacgaacttagagcattctattttccatactatttcctttctaattcatgctaatagtggttcttcttttggagtttccttttgggactctccattttccttttctggttccgaagccttgagttctcccaattcctttgttgatgggagttgatccagtctatcttgcacaccaggtgcagtctccttggtaccgttaacctcacggtctaactgttccaattctctatcaacttcatcatttatcgtagatccgacaaccgcgtttgataaagcatcgtctatctctctttgaatttctatctgttctgcagcagtatccataatactctctactttctctagattcaactcaacgttaagcttctttaacaattgatttcccttctgtagtccatcgataaatttcttttctattagtttaaattcaatggattggaccattgtctccaaatttattatctgatcagaacactgttccaataatcgttcctgataatgtatccgctttaacaacaatctcgcacgattatcctgtttcaattgcttccccttaagtttaatgcaaagagtccttaactcagctctttcgacccctatcaaattttcagtacgacgagaatatctatgtaactcatctttagccatcttcagttgcaacattgccttatcggactctgtaacttttattcgacttccttgttgtcccatctcgtgaatatatgtgcttgtttttatactaccaaaagtactaacaagtgtagctattgaactaccactttcgattccgttactaactccaaacccttctccaatatcaaaaagtcgtttgacaataagtcttcaactgttgggctttcctcatagatgcatagaatggatattcactgtatcgataacgcataatggacctttggatcgacataaagatttcaagatagtatatttaaatattacccagacaaagtcacatgcaacccatttgccagaaaaagatgaaatagtattcaagtcacgtgaaattacacagaacactgcttgtaaaagaccgctctgggcggtcgcaagcacaacaacatgaaatcaagccgcaagaagttagccagccgcctacttcgtagttaaagggtttttgacatattctcgagatgaatcatgtcaactatacgatcatttgtagttgaacactatcatacacacttgttcggttgtgttgtcttgtatgctacattttctggtgggataaggacagcatcttaagctgaagacaccaagatgactaactaagcgtaaacggcttttctatgcgtgtttaacccaaagcacttgaatatttcaggtgaatcgtactactctgcaaggatgaaccgcaatatgatcccaaagacgaatcgaacctactgtcccttgtcggattattaactgatcagtcacaatgaatatgcatcatcttacatataaaactttttgtttctttccacttttctctgcgaaaaagctttgaaaaattgtaaaaagtaaagtgaggcgatagtaagaattagaattgacttcttgttaacctagccatgtcatgagacaaagttattgatcaattataagttgataaataacgaggccctccatagctttttcatcacaaatttaatcgactggtaatactattaaatcggttagcggtgcctacgtttgattctattgtttctaccggtttatcattaataattagtaaggacttttgaaagtaaaaagccttaccacaaggaagaactaaaaatcaaatctccaaatatgggttacgatactcgccatgatgttatcgacttagtcggcaacactcctttaattcgcttgcaaaaattgccaaaggcaattggtatcaaacctaaggtctatgccaagttagagttgtacaacccaggtggttccatcaaggaccgtattgctaagtccatgatcgaagctgctgaagaagaaggtatcattcatccatccagatccactttgattgaaccaacttccggtaacaccggtattggtttggctttgatcggtgccattaagggttacagaactatcattactctacctgaaaagatgtctaacgaaaaggtttctgtcttgaaggctctaggtgctgaaattatcagaactccaactgctgctgcctgggattctccagaatctcatatcggtgttgccttacgtttagaaaaggaaattccaggtggtatcatcttggatcaatacaataacatgaagaatccagaagctcactacttcggtactggtaaggaaatccaccaccaattggaagatttatctttgttctccaagttgaaagctgttgtcgctggtgctggtacaggtggtactatctccggtatctcgaaatatatcaaggaacagaacgacaaaattgccattgtcggcgctgatcctgttggttccattttggctgtcccagaaaaattaaacgaaaccgatgtcactgaatacaaggtagaaggtattggttacgattttgttccaaaggttttgaaccgtgattctgttgaccattgggtcaagactgatgacaaatcctctttcaaatatgctcgtcaattgatctccaacgaaggtgttctagttggtggtagtagtggtagtgcatttactgctttggttgattactgtaacgaacatccagaattgactgaagatgatgttatcgtcgttatcttcccagattccgtcagatcctacttgactaagttcgtcgatgatgaatggctaaagaccaacggcctatgggatgatgccattgccactccaattgtgcaaaaagaaaccgatgtttttgaagatgccaccgtgaaggatttgaacttgaaaccagtggtctctgttgaagaagacgcttctgttgctactgtcatcaagattttaagagataactcgttcgatcaactacctgtgttaacaaaggatggaaagttgtgcggtttggtaactttgtctcaattattaaagaaattatccacttccaaggatgtttctagcattaaaagtctgttctttgatttccgtaagttgaataactttgatgacatctcttcctataacgccgacaagtctcataagaagatatttgttcgtttcgatgtcaatacaactttgtctgagttgaactctttctttgaaaagaactcagcagctatcattactgagggtctgaacccagtccatattgtcacaaaggtggatttattatcttacttggccaaataaaaaaaggatatttcattaaactaagaatcatgtccaaagtgcaaggtatatttccacttacattcaatatatcacaaccccaagccaatcaatcctgcaatgaaataatttcataaaatatacatatttgttgtaaaagtatagtatagatatctattgacataaagtatacaaacagacagtctattatcaacatgcctgatgattcttccagtgaataatcaggaagtgagatgcaggaagtcattgaacaatattacttcttttcgattcctagaactttcatcaaaggccctagttggtcaggacccaaatttatgccagatttgtccatctctgatttgaatttctgcatagcttctctaatatccttatccatcataagctttaccatctgcatgatacttggaggttcattcgattctggatcaattaacttcttttctcgcatgatactgttaagattttccaaggattccacaatagatggatgggaatgaatctcgtccataagtttctgtactttgacatgagcatccagatcctcgggtgatttgtcccatgacgaagcatatctcttgttttgtagaagaggaatgattgttctacaacttctttgagcagtaactgctccaaatgtggcagctcttagcccagaacggaatacagaacgcgataacatgttttctatatgaggattattgaagttccacagcaacaggaccggttaggtctcggatattctatattttcttaatttagtatgcaagcggaaagataattgcgctttcacatttttttgaagttgataaaatttcagaccttaacatgatggactgttatcgaacaggagtctgaaggtaataattgaaggtgagcaccgactattttcatttgagcttgcaatatataaacaaatcgaactacaatgaattcaacaccatctgtagagtatttaccatagatacgattcttaattgtgatattacaactttggtcatttatacatgaaatactagttagccggaagaatgtatgatgtagaattggcggatgctatgtgtacacatctagctagcaatgaaataacgaaagagttttagtgcttgatcactgccatcatcatgctgctttagtgtatcatatgccaaggctatcttcgtaaaattcaaagtgagaatttcaactacgagaacttccatctattaccgcaattctcacatgtacaaaaagtagtaagaggttcatccgcagatcttgtttgtagttggtagtatgatacttttctttgtttacatttgccacattggaatctatctgttactgatctttctacagttgcaccttgtgcattaaacaaattctgtttctcaatttcctcaattttcttctttaaatgttccggtgccaagtccttaggatcagcagtcactaaatgtttggctgatacttctccattcgtaattctatgtttcaaatctggattgttcttggagattatatttgagtaaattattctgtatttgtcacgatatcccttttcgtcagactcgggattgaacagattagccatttctgtctcaatactcattactgtatctaggatagctactggaggatgttcactttcttttgccaatgcatcatataatgccctaatagccatatctctaatcttgacaccatatatatccgttttcacaccgtcgttcttagcatttcttggagctttgctgacatatttctccttctttactgcttctccaccgcttgtaccattattgttacttgtagatgaggaattgctgcttagtttgcttttcttttcacgagccacagcatctttccaggataaaatcatcttcttcaccaatttgacgatgtctggattggaagatttcttaaattggttgactacgacccctactttcgtctctctaagaagcttctcattaacatctttcaaatctttatctaatgactgtagaatcttgaacacaacatcattattatttttgttcttctctaatcctttgacggcttctaaaacgtccttggtttccatatccgcagaagatatctcagtttctatctatattccaggatcaatttctttcgaagatgaagaatgaatgttaataatacacagcaaatattgctctcaacagattctaatgagttaggacctgctgaaatccaccatttggacaatggacagtgttgattgtttgaagtcattaattagttttcaattctaatttcatttcattcgaacattgaaaaaaaaattagaattgaagttgatgacgaaagttgaagaatcgaacaataaagccatatctgagttttattacacttataaagtaccgctaagagcatcgaaggacttgtaagacagacttccaccagacagctagctgtgaaaataacctggtgcaaccaatttcaatcatagaaatagttaaaaagcaatgaacaggggaaatccatcgcgcacagtttatttaggttcgataccgtatgaccaaacagaacaacaaatattagacctatgtcagacgataggaccagtaacggcaatgaagatgatgtttgacccaacgacgggtaaatctaagggttatgcttttattgaattcaaagatttggcaacttcggcaagtgcagttagaaacttgaacgggtatacattgggttcaagatcgttaaagtgcggatacaccaccggtagtggcataaacggcagcggatctggccccggagatgaagaggagaatggaaacatggttgaggatgtgaagttcccatggctcccggtaggggtggacgttaacatcaatatgactacaccagcaatgtgtatcagtagtgaattggggaagctacaaaaggaccaacagatggctctactaaaagtaatccaacatttctgtaaagacgacaaggaaactttcgtagcactcctagaagaggcacctcaattgagctatgctattgcggaactcctgttgagtaacggtgtgtgcagtgtggaccaattgacacaattggctatggcgagtaaacaaaggccagaggaacagactgataacacagtggaagacggattagacgaagagaaagtggatcttctaaggcaagttctacagctacaggattcagatatagcaatgcttccgcaagacgaaaagatggcagtttgggaactcaaacagagggcaatgaaaggtgaattcggtcatctttaatagatcgtctcatggatggaaaatcaaaaataatgaacatgcgtcaactataaagttcattaatgcttatagatgaaacggtgtagaatgtacaaattgaatacgcactttcggatgaagtaaagttcagtctctaaaatataccttcaatgagccagaatgcgcttgacggtaagacagaagtagcagtataattttatggaaataatgaagagaagggttaataaccaagcttactccacgtatgcagtatctattcaaattaattaactctgtaaagtcacgtgtatcagctccaagaaaatgaaattaactagcgtctaccctattaacatttgtgaaaacttcaacccagaatgagctgaaagacactaaggtggaggctttaacggataagaagagtactcatgtgtggaaagcaataatccgagtcaagtatagcacaattttttcaagttaatcgtcaatgatatccatctgatgatgatgctgctgctgtaaaatgacaactgccgcaaacatcgtttctctgccaccaagtttgtgacaaatgaataagctttctcagccttgcttcatatgtagcaaggctaaaggaaatacaaccgtccatagcggactaggccatgaaccagttaccatcgagatttttaagcaaccagaaaaataagtgttcttattcgaatggcatatttctctggcagccgtaaagtctcacgaaagacacagacacagaaacttcatagccaaaaaaaaaaattaatttacaactagcttcagcagtgaacctaaccttaatttcgtgcaggtacggtcaaggggtcctgtttatcgaattatctttctacggaggtataagcgtcgaacctttgtgattgttgttcggaaataggtttgtgtgattgtgtttagtaacctatttggatgtctttgatattcgaagataccccaaattcggtcgttacggttccttccagtatcataactcgatgatagtgacttttgttcctttcgattctgccagttcctcgtgacattataaagcttttatggtttaattcgacatccgtaaggtatttcctttgaagtctttcgaagactctttcgatcgaatggtttacgcttcttattccggtacaagggcctgaaatatgacttcgaccctaacaacacttccaaattacactgttaatttccattcgccatgttttaatatgtcatacgaagttgattaagaacccaagagtatataaatgatgaacagacaccactaatttcttcatcggcttgagttcagtttgttttgagatgtgattggatctggtatttaagatagagtttcacacatagaaactacaaaccgcaagtgggtaactgttcattttaagttcaacaatggtggattttgaaaaacagagggttgactcggatgtgaaaaggatttcactatccagttatgatgttgaattacgttctcaggattcattggatagtgataatccgtttagtgatcccctgatcgccgaatattatcgtgcactatatgaagaaagcaaatacgagagtagaagcgcatttgatccggcgttcacatggacaaaggaagaggagaagaaattgctttggaagttgaacttcagagttgcatttgtggcatgttttttgtttattgctcttcaattggaccgtggtaatttatctcaggcagtggccgacaatcttcttgaagatttacacatggataccaatgactttaatttgggtaaccaattgttctacctctcctttttccttgcagaattgccttctcagttgatttccaaaagattgggtcctgatattttcattcccattcaaatttgtgcttggtccgtcgttgccatggcgcaggctgctatgcataataaagcagggtttttgatctgcagatgtttgattggagctctcgagggtggatttattgctgaccttgttttatggctaacttacttcttcactagtaaagaactttcaatcaggttatcatggttctggactagtttatcaatcgttcaagttgtgagtgctttactggcgtacggtattttaagaatgagaggcatcggtggtcttgctggatggcaatacttgttcttgctagaaggaattttaaccttcctcattggtctttccggtttttatctaatggtccctggcgccgtccaaacgaaaaattggatgcatccaaaggggtggttcacagaaagagaggaaaagattgttgttaacagagttcttagagatgatccatctaaaggtgacatgcataatagacaaccgatctctttcaagttgctgtggagtgctatctctgattatgatctatggccaatttacttgattgggttgattgcttatgtcccaatgaacactgtatcgacatatctaacattaacactaaaatctgtgggattcagcactttgaatgtgcagctactttctattccataccaagttatccacattactcttctcattggagttacttggtacgcagaaagaattgaccaaagagcgtacatgggagttatcgcttcgatttggaatgccttgttccttggtgttctaagatggtggaagggatccctagttgaggcatggcctacattcgcgttgtgtacattattactgggtggtccatacgtgcatgcaatctgtgttagttgggtctctagaaactccaattctatcaaaactagagctttgagttctgcattgtataatatggccgttcaagtaggtgcaatttattccactcaaatctacagaaaaaatgatgcaccgttgtatcataccggtaacaccgttctatttgcgatatccattgcaggtattccggttttcctctttgcgaaatggtattaccgcacaagaaacaagcgaaaggaagctatctggagccaaatgtccgaggacgaacgtgtcgaatatatccaaacgaccagcgaccaagcaaataaaagattagattttagatttgctgagtgaatttcgtgaactgtattatttgttacttttgtttacaatgtgcacggcatgaattccctgtatactacatgcatatataccagaactttgatctttaatctataaaagttttaactacaacattgtttaattcattatgaaaactcttttttaaccacatttcccggcttgcttcatccctttttctacatcgacactgaagaatagtagtagagccaccaaatataataatgtgttcggaatgaatggcatcctggagttccctgtcttatcttgaagtaaagcaacaatcaaagattcagaccaaccagtacataaaccaagcattacttcaaagccaaaatattggttttctttacctgtaggtaacattgcactatatgcaacgcggttgattgttctgataccagaacttgtgctaacgaacaaaatctgaaataaccagaattcccatcgatatttaaagccaaccttactattgaagttagttcctagacatccccaaaaattggtgaatgttcccactaacaacatcccatacaatgatcgtttcatgtacgtgatgctgtagaagcttggtttgttgctgcaggcgtacgagtaaaatgccatccaacataatggccctaaacaggcaactattaggttcataaattgccaaatggcaaactcagcatccgatgaaccgattcccatggtcgatctgaagagtaatccgaataccgagagaaaattcgaatacgcaatattccaaagtacccaagcaacacagaatttgaatgcttctctgtaatccaataaatccataaaaatttctttgaatctaaccaatggcattattatcaaatctctcacacctttattctggaattcttttcctttcaagctcggtattaggtttgcacatataattgatataaatgtagtgacgaatcctgcaacagtcactgccaatagaaagtccttgtttgaaggatgagaagatgcatgggtaataataactccaactaaagaagcgataattcccccaatatttccaacaacaagaccccaggtgctgacgttaacacctcgcaacatgaccccaccttgttttgaattgtgctcatcttgtaaagcaagttttcttgcattcataaagacaggaatgtatgagctttcagtgatttggtatattgtaccaaagcaaagcataagacaatacaacactgattgctggactaaggtttgatattttttagtatcggataaccagtagaatggaatagcaaagataccatacgatgccgttgcgccaatcattagccattttctatagtccgaataatcagcgaaggccatcattaaaattgcaatcgcaccttctaaagacgtataaatggcctttaagtagagagaaaaagacgtgtattgaactgttccgtaactaaaagtaacataacagtcgtcccctgtggctaaacagggaccagatgaaccttttggatgacctaacgcatgtgctgttgtttgtatcgttgcagggacatacgatctcatcatcgcagccgtaggacctgtagaaaagcagattaatagccaaacaaggtaagtcttcctggtatcccacttggatagttgagagtctttgaaattgcatgatgcagacgaaatctgttcttgttggaatgtctcatcatgttcacacacaagctcttgtactgaagcatcagctgtcagttttttggagcctgacagagtagaacagccggtgctattcggtttgagaggtgtactttccagcatttcattcatatcaaagtactatttcgctgtgacaatactatatcaagtccaaaggtcattcggggaaaaatgtctgacgcgaacaacccatatactcaagttgaccatttatttatattcaaagaaaaaactgcttttcatatccactcaacaagtaacatttcctagttgtgataaagcagcaacaatgatcttggtaatatactaaattttgaaacgcaactgggacttttgagtgcattcttcgatattaaagattagtaccaaataataattgctcacgagtgaataagaatatttcaagagataaaaagtgcacaaaacacaagcctgagatgaagcccaaaaaactaatcaactaaccaattaaaacttgtagtgagcaatgtcactgtactctaccagctcctgattttacctaacacattcatttaaatcatgtgtcaattgattagttcaaatgtcaagtgaagcaaagaattctgtcgcgtgtcaaaagttggcgagtcagttaatttcatgtcaacaaaatgaaacacttacgcacgtgattggcaaatagatcgcagcagcttcagtacattagtccagcgagccaaaaaaacctcaatcgagtaattctttgcctggcatctacacatcacgtgacttaaatcgatactatcgaaaacataactccttcctacaaaccgccgcactgtcgaggagagcgtgatcaaatagcgaaactatttcatgaccgtttctgtcgaactttctggaaaaatgaaaaaaaaaatgaaaataatgtgagcggccataaggcatcattcaaaacgatgtacagctcctgattctccaggcgaaaagccaaatccaaaaaaactggacatccaaatgtctataacaaaaatggacgaatgacggttatattaggtaaaaataattcagttaggtaatggtggtgaatagcgaactcggagaaactgccagaaaaaaataatcgacaatagcggaacctgcctcacgattacagaagaggatagaactcttgtgtgtatataggaattttaattaactctttgactacttttttttggaattaattagctggcagaaaatgaaagaattctatgggctcgcagtggagttcagcaatgcggacatggctggctgctatctagtaagagttaacccaactattgttcgaatccttattcctatttctcttaaatgtgtaatctgaccggttgatccgcaactttatatgccattttctgtgtagctttctttccaaatttctcgattttatcatcttcattttttagatatttttttcacggaatataaaggaaggagtagaggcgaaaaaaaaaaaggatttataaaggatcaaataattataagattggaaggattactagaagctaagtggttttttgattgattgattgttgtcttctttgtgacattagctgaaggaactagtgatagcaagattttcgaagcaaaagtaacattttccagtaggtggtgtttttttttttttggattctgatttctttacctgttatagattttttaatatacgagaatagtcactatgttgagaagtaccgtaaagccaggcaatttgaccttgaagagaagcactcaattgttgagtcgtcgtctatattcttcgcacaaagaattaaagtttggtgttgaaggtagagctgccttgttaaagggtgttgaaactctagcggaagctgtttctgccactttgggtccaaaaggtagaaacgttttgattgagcaaccatttggcgctccaaagatcaccaaggatggtgttactgttgctagagccattactttggaagataagttcgaaaacatgggtgctaagcttttacaagaagttgcttccaagacaaacgaagctgccggtgacggtaccacttctgccactgtcttaggtaaggccattttcactgaatccgttaagaatgttgcagctggttgtaacccaatggatttgagaagaggtactcaagctgctgtcgaaaaagtaattcaatacttgtcagagaacaagaaagaaatcaccacttctgctgaaatcgctcaagtggcaactatttctgccaacggggatgctcacgttggtaagttgttggcttcagccatggaaaaagttggtaaggaaggtgtcatcactatcagagagggtagaaccttggaagatgaattggaagtcactgaaggtatgagattcgaccgtggtttcatttctccatactttattaccgacgctaaatctggtaaggtggaatttgaaaaacctttgatcttattgagtgaaaagaagatctcctcaatccaggatatcttgccttctttggaattgtcaaaccaaaccagaagaccattgttgatcatcgccgaagatattgatggcgaagctttggctgcttgtattttgaacaagttgagaggtcaagttcaagtttgtgccgttaaagctccaggtttcggtgataacaggaagaacaccttgggcgatattgccatcttgtctggtggtactgtcttcactgaagaattggacctaaagccagaaaacgctaccatccaacatttgggttcttgtgattctgtttctattaccaaggaagataccgttatcttgaatggtaacggtccaaaagaaaacatcgaaaccagaattgaacaaatcaagaactctattgacttgaccactaccaactcttacgaaaaggaaaagttgcaagaacgtttagctaagttgtccggcggtgttgccgtcattagagtcggtggttcttccgaagtcgaagtcggcgaaaagaaggaccgttacgatgacgctttgaacgctacaagagctgctgtcgaagaaggtatcttgccaggtggtggtactgctttgctaaaggcttctagagtcttggacgaagtcgcaacagaaaactttgaccaaaagttgggtgttgacatcatcagaaaggccatttccagaccagctagaaagatcatcgagaacgctggtgaagaaggctccgttatcgtcggtaagattatcgatgaatacggccaagactttaccaagggttacaatgcagccaagggtgaatacaccgacatgttggctgctggtattatcgatccattcaaggttgtcagaagcggtctagtagacgctgctggtgttgcttctctattggctaccactgaagttgctatcgttgatgctccaaagccagctggtgctgctccagctatgccaggtggtatgccaggtatgccaggcatgatgtaaagtggaacaattacttgaaaacttgaaaagtgaaacagatcaaagaaaacaaccgtcaaaaaatgttagaattacaagaatttttactgaacattagctttttcacctaaaatacattccacttttatttaaatgaatatataacgtacgtataatgacgatcccgtgtaaataaaaagatacttctacatgtttaaatagtttcctcatcatcaacccgcttttcaacacttcctctgtccttgacaggatggctagcattctccagaaggtacagagaaaaaggaaaaagcagagtgaaaagaaaaaaatttggggcgagctgggaattgaacccagggcctctcgcatgctttgcagtagttaaacctcgtttatcgaagcttcgctaggctattaacccaaagcgagaatcataccactagaccacacgccctaatttatgaaaactgaaaagcgtcatcttgttacattgaaaatgcagtaccataacttatgagtatgcattacctgattttgccaaaagatgacgtttaaaaattaaggttggattcactgccaactgttaagatcgatgttgaattatcatcaatggcaagcaaacaaagatattccaccaaataaggcacttcaaaataacagttatgaaacgggtattttggttgttatgtccagttttatttttagctccctatgttttgccgatttcacttggaacagctgataaagatggaatactgaacgtatattttgttaagtttggttggttttggacatcggtaatatcatgcttatgtgtgataaggtactctaatatagtcaaccattggaaaaggtacctgctattaacgttatggtggatgatatttacccaagaagtatttggattgacgccgctaatggatctagtgttccttaacagcggaggaatttgttcatttgacatatttagtacagatggcaatgaacagacactgaatttgcaattccatgacaatgagtttagaaggcttaggggaatacgaaggatgctaaattggcttggtaatgtgcatggtagtgaaacacttttatctgcgttgaactctattatctcggaagatagttcagagtatactccagaacttgctgctgaattatctgaattatccaaattggtgaagtcaagtgctggttgctcatatgctggaggacactgggttggcggacatgatccaagtggacatatatttttgataacacttatgcttatgttgatgtttggggagttatcattatatcaaagtcgtgcatttagacacttgcaaaatacttataaaagatttttgaaccgggcaggtagtcagttattacaacttctagataatagtgcattggctaatttatggattcatgatgatcatgatgatgattcacaatggtggttcaagtttctctttcaacctccattgtcatgttaccagaccttaatgaccttaatatatctgattctgaggtttataatttgggaaaatccgatactattactattcactttaacagcgttgtggtcatactcatttgtagtgacagtaatgctctttcacacattttgggagcagttatccgggtttgttgctgcatatttggtttgcattcttgtgtatcaattcttttaactgatcataatgtcacgtaatatatttcgtttatatacaagttatttacaaagctctagaaatattttggtaatgttcataaatcatcatgtaatgcctcatcaaaaacttcgtttgaagcaaggtcaaacatatcttcaaagtttactccagaatctctccaaatttcattgaaaataagttcgatgtctgcttgttcgactggaggaaaaactggctctaccagtgggctggaacgctgtaaatcgtcagctacaacaatttctgtaggtatgtttcttattggagactgtggattttgcttggtagagtgaagaccgacaattttttctagtattaaacgagttgtccgctcaaaaaggaacatctgtacgaaaggagcacggtttgagacgtattgaaaaaccggtaggagatttggatgccttaattggtcactgcacaatttgaatcctttatagtatgacatgaaggaaattggagttttcggaaggggttcccgattcactacaaaaggttgttcgttcggcattgataaatttcgcgctcaaagccattgaatataggagttcatatccctgcattagagctctgatccaatgcgaagatatagctccgatcaaaaatcttagatttgaagctaacgatgaggactgcatgacattgccgtgagattcttcatagtctaactggtaacattttacgattgaaccgaagaccaagtctgtggacatcatggtatattttccgaaggcgttactgttagaagctgatgtatctttgaaccataatcgtttcaaatttcttagcgtgcaaataatactgagaattgggaaggaaagaaccatttccgctagcggcaagggtctagagagagttttatcggctgcaaagtaatcaatattttcaggccaaatttcgtccaacaaggtttccataaaattcgtgtaaagatccaaatcaggtattttatctctagtatggagaccatttaggattgatctaccgtaaaagataaatttccgtaattttctcataaaggcagctccaaactcttgatttggctcatcagacagaggttcgctttctttccataatgactctgtatcaaacatctctgcagaaaccaaaagtggacgaccaatatcaaaagcaatggtaatgtcatagaagagaatccagttccataagtttttaagtattctttcatcaccctgcaaagcgtcaattgaatcgttcaatccaacatccaaagctgacattaccatcagttctacaacggcaagtaagtgcgaattatcaccaccactttgatgtcttgaggatttccaaatatagtgtagtaaaaggaattgaactcgttcaatatagcagatttttgcagtattctggccaattaacataacgaaaaaactgataaagctatggggcatctgatccttcaaaattgtatataagtgcaacactatcgcaatagggtagtagtttaatttactgtgagggataagctcaatgatacggtcatcaactactttaaaacaatcggtaagatactgcatgattttatcttctgaaaagatattatgaaggtgaaatcctttgtagccgaaagaatgcattaccgcggtacaaagctcagaatactttggaaggtctgatataaccataccgagtgaccaaggagtttcaatcctttgcaattcatataacatcgaagttcctgttcttgccttaagtttcaacctttccttcttatgtaccatgagcacttcttggaaataattagtcacattttcactactcagtctaatgattgttctagtagatgtacaaccataacgaatgatcctatcgtgctttttcatgacatatttacaccgtactaaaggattcgcttctttctttatcaagccgtatatcgacaacctcttcaacgtctctggctctagatgcttctctgtaccctctacctttaattgttgcttcaagctttctatttcatttagtaattgcaagtttgggctcttattgtatacatcatcatgtgagatgtcaaaattatacccatcggtgtaaacacactcagatagacctctcatcttgcacccagtacacatgggacgcttacgatcacacttcaatttacgtttacgacaaaaagtgcatgatttaataactttccttctctttcttactttgccattactcgtgctagcgttcttatcgctataatgttcctcatcgttgttatgactgccgatcccagcgctttcttcagaatttcccgttccaatatcttgtgccgcttcatttttgttataaagaacgctcatttcggtagcaaaatcagatattgcatcgtcattggttgatttcttacaagctgtctgagtctcgttagaattttggccctccaaaggtcctttactcataatgtaaacaaccaaaatggaacaacagaccaacaaatgccccccaagtataaaaagctaatcaacaactatttcttgactgggagaaaaaaaaagatcaatagtacttgaattgttacaacaaatgcattagcaacaataccaatccacctcttaaactgatattggtaacttctgaattatcagccggctctctctgccatcatatataaaaatatgactgaatttgattgaaaaaggtcttttgtacttacttgaaaatataaactaacagaaacaaaaatgacgaaatgcaacaaatcaacaattctacttgtaagacttgcatgaaactcatgtaacgtatgaggtccagaataatatatatataaatttaaagagaccaaacaccgttgtgtagtactgcagtttgcatcgtccttattactgcaaaggaaaaaaaaaggtctggtaaatggccggctggcagcaatataaaattactttttccgtatttactgggatgaaataccaggcttcttgtcatgaaatatttgcatttaatattagtactactggtagtactactggtagtactttcttcagataataattatttaggtgtaatgaaagatgcgctgcagattctaacacaagtgctgcctcaatttccaattccttggtgtgcggttttctgtttcgcgattatgccagatatggtagagaagcgaatctatgctacaatcagggcgtaggaaatctggaaaaaaaaggttcagagccttagcaacaggaacgtagaaacggcatataacagagtgtgagtgaatgtgcctgtaggtgtcctctcatgtgactgacagataaacaggaagccctttgtagtgggggttattggatctgcgtaggtgtacactgtgccaatgttcttttctttggcgatttgaatagcgataattccggaatagttacactatatatggtatcaatactgtatgagtcaatacatttgtcgccttattctgtataccagagattactaatgtatatgaatagtcgaagatcaatgtgcagcagcacattgatcttcttgtctctccctttctgtattcaaggcaagggaaaagtcttatgcggctgggtttagtgggttttggacttgtggaccaaaaataagtaaactgtagtatagaaggattaggtaatttgtgtacgtagtgatatatttgataaaagccatcatgtgagaaagggtggggtcaattgttctatcggttttcagtgatgtgttaagatgataatgtctatttaattggacactttccattggtctaatggcactttgcatagttttatagcagtaggttttaggtaagtagtgaatatgagcaggcctgatacaatgcagaataaattggtgatataatagccatctcttattgtattcagctggccaccaatgctgacgcattgctctttagttagagattggccttgaatgaggggcacgcctgtgcagtcgtacttggagaagaagtcaatcatgctcataatcagcagtctgggccatgtaccaccaaggttgctcaacgtgtttaggagagtcatatacgttcctccgatgactggatctgctacttgggtatggaaagcagacatgctgacgaattggaaggtgctcatgaaggatcccaatagatgttggcacaagactagtaggaaaaatgacatgctgatctcggattcatcttctgggaaaagataaacaacaacgtttccgagaatagcggcagataaacggccaatgaacccgatgatccatggggtcaacgttcttgcatctccagcaacggccctgataattttattattaaaggagtaaccagctcttgataacctggccacgtagaagccgaataagagctcgaaggggaaattgatcaaaactgtaatggctaaatcttcccgtttcaaacctttctcgagcaattttaagttagtagctgcatcgttacactggaatgcaaacttggatattagatgaacaatggctagtgtttgaacgctgggtaatttcatcaccttaatgaataatctgtaaatgttaatcaaatcatggctttcgttgtcttcttcttcatcaggttggtattctatcattttttcgtcgtcatctttcttgatatgggaatgtgtctccacatgtaccttttctgatgtaaataagctcacataaaacgttacagcaagatataacagtccggtaaacgttaaatatgatgataactggaataatctatcgcgatggaagtacttctgcataaattcatcactgcttaaacttaggaaaatggtaaaactcataaaatatccgatgttcaatccgatcgtttgagcagtcgatgcataactcaagctttccttacttaatatgttaagggcccatccatcaacagcaatgtcttgggtggaacacaaaatgaccagaaacaagaacaccgaggtaagagccttcatgtcaacttttgagacatcttttggtaatatcttgtcttttgaaatgcaatatccaagcgtcaataacgttattcctgtaacgaattgaacgggaatgatccacgatctccgacgacctaccttctgggagtaccatgaatcaactatcggtgaccataggattttgaatgagtatggatatgtagccattgaaaacaacccaatggttacgaaggaggtttgtctttgggaggatttcaatatgaatgggatcgttccaaaggttaaccccacaggtatgccttgcaaaagatataataccactaggagatagaattgcttcctatcatgcggaggtaaagccatttttaaaatctgcgaccactgaggactctcaattcctgattattgactcaccctactgattctaaatacaataaccgttgctcgaagcttacagcccacagcccagttttacacctgtctgcctgaatcggctcttatatacatctaattttcaattttgccagattgaaaaaaaaatcgaaggctgtgtatttctgactgagaatacaccctcgacgttataagtcagtttagatacaagcatttcattcattacggatccaaaaattacacatctacggtacttacatatcagatacatatctaaacgcattttctggcaaccaatccgaatatttgaagaaaaataatctcctttgtttcttaacatttcaactgaaaccttctagcgtaactgataggtctctctccttacctattcaattcattccagtagtacgtcaagtacgcattggatggcctaaaagtgcctgattgtgtgtacatgcgtaagtgtttggctaatagttcttagcgaaaaaaaatacttccccataaacgacgaatattctgccatttcaggcaaatagctgcccttatatttgttaacaacttggtaagcttaatttccaatttaagtgttatgaacctctctcctggtccagtcttaaaccctctaatgtatcctacatcgctaaagccatttcagcttagaaagtgtaaaagacaataccttgatggaaataacgacaagttgtacagaaagtagcgcacagcgtcttgttttaacggcagaatatatatatacagtttaatctcataacaaccgcagttgtccccaaataccttattgttcccatctctagtgatgaaaacttttcttcatcattactgatgggcaacatacatgaaaaaaaattgtaaaatctctaattcatcaacttacctttaccagcgaataattcaacgacaggcaactctatctcattctatttcctaatccaaaatcgtgtattaactgaacttggtattcatatcttaataatataatatgttttaatttttctatttttctttgaagtttgtaaatcaattcataacttagtttattgcaacaaaggagtacaatcataagaaaaaccgaatgcgaatgaaccatcatgcactattccttatccaatgaatattctcttttgttttgataaaaaacggaggccaacagaggtgcataactgtcagtaaagaaagagtgcacggtgcaatcattcaatagacaaaacacttttagcagctctgacaatggtgtcagggtctgggaaagcaaaatcttctaattccttagcataaggagttgggacttcagcaccagtaactctttgaattggagcatccaaataatcgaaggcttcagattccataatttgagcgataatttcagcaccaacaccgaaagctgggaaagtagattcaacagtaatcaagtggttggtcttcttgacagtgttgatgatagcttcaacatccaaaggtctaatggctctcaaattgataacttcagcagaaacaccgtattgcttagacaaaatttcagcagcttccaaagagaattgaacatttctggtgtaactgatgatagagatatcagaaccttctctttcaacctttgctttgtatggcaaagtgaaatcagtagacagagattcttcagagacttcgaaagattgaccgtataacaattcgttttccaagaaaacaactgggtttggatcacgaatggcagccttcaacaaacctctagcatcttcagcagagtatggaaccaaaaccttcatacctggaacagaaccgtaccaagcagaataatcttgggaatgttgagcagcaacaccgacagcagaaccgtttggacctctgaaaacgatttgacatttctgagtaccaccggacatatagtaagtcttagcagcggagttaatgacttgatccatagcttgcatggagaagttgaaagacatgaattcaacaattggctttaaacccttcaaagcggcaccaacagccaaaccagtgaaacccatttcggtaattggagtgtcaacaactcttctttcaccgaaacggtccaataaacccttggtaaccttgtaagcaccattatattgagcaacttcttcaccaatgatgaaaacatcatcatcacggtccatttcttcggccatggcagaattcaaagcttctctgacggtcatggtcttggtagaagcaaatctcatggattgaaccacagaaggaacagccctcttaaaagtgttagaaagcatcatcatgttgtattagtatttaataattttgccagttgaaagtttttatcaatcgggtactaacgtttcgtttcactacgtgtaattcttcttaacctttaaaattgtcttcgcttgtaaaacgtttactgaaccaaaggagaatgaatattatactagagtttgatatcttttcgtttttctttttcttttaaaggtagaagaaataatgttttgataattcgaaaacaaaaacgaagcaataaacaaacagacagaagttgttgagatgcgtttgttataagacagacaaattagatagtcaattgtcaattctataactaaaaaggatccttttcaactgaattcttttttataatttcttgaatttgatattattttttcactgaaaaaaaataaaaactcgttctttgacctattcaacaaatagacgttagcctcagggaaccgctaattgagtgggattggatgagaatctgtagtaagatttataaaacctttaagaaattataaagtaagattaaacaagtattgaattacagatccataaagtataaaaaatgaaacacaaaacagaagataatacaatgaataaaggaataacgactctaaagaactaacaacttccctggtgctgaaatgaccctcttatatttctttatatattggtgaaatcaaaatcctttaaaggaatatatatgcgctgcataagcttttttttattcgtttcgactgtacgggtcgagcgattcgcgggttgctataccgttgtatttatctcatagatatgctagcgcatagtaagtgcgccatcacaaatctgctgaaaaaacctgttttggcgacgggagaatacgacatagcagatgagattgatggaggcgatgaggtgtataggtgttcaaacgacggaaaagggtgggggcacgtgatgcgtgggaatgatgcggacattgtcaatttttctgttattccggtgtgatacctaaataatccgggtaacgtaaagcgctgacagatgtcagcgccttagaatgttgttagatggtattattgtgtatatcatcattgaacgacagaggtataaggttcgtcagttgctgagtaacgctgaaatttcaatggatacggcgtcaccacttttactgtgggcagaacagttatgtcttcgggtacccttgacccaattgttcttcctggcggttgttgggcacttgctagtgttaaccgtactttgtttctccccatggttgtcgtgtatagaataccgcattcgtaattggtaggtttttttagtgggctgggaccccatgcagcttgggaaaggttatgactggtgagtagtatccaatctggtcgcttgagtgtattttcatctgtgaattgtatataatatttggtatggcttggaaccatatgcctattcttatcggactgtgtcgcgtttgttggcagagggacatgttttcttaaacaaggcactactttcctctcagtttgttctgatcttttgtaaaaaaaccaatttgcacttagcccctgtgtcatacactctttgatctcggttttagtaggccataccaatgtcgagtgcgctaggaacggtgtcgtatattccttggatttcaattttttatcgtacccatccttttcgaaccaatcggtgtataagtacggtatcataacgtcctgtaggagatcgaatttttttctgaatgggttccccatagaacttacctgtatgaaaagatttacaaatgaaagatcatcatcttcttcatcgccatgcaatttcataccagatgctctcaaacacgacttcaattgtgtcaaaccaccgttatatggggttgagtacacaaattgacaattttgttcgtccaagacatgccatttgtaccgctttaaagatgcaatcaaaccatataatgacgtatacgatgagtacgaattaaggtactccaataattcgtcctcaaaccgggatttctttttcggtactgtttctgacttctcgtataacaggggtgaggtccatactgtctgctgaaccaagttcatctcttcacgagatagattaaatgacggtacatgcattctcatcgtcccattttgatgaaacgagaaaataatcttggaatgatgacaaccccaaggcgagggaatatcaactcgatgcactttcaggtttgcataatgcgatatcggttgttccgaattgattgtgttcaattgacccactatatgaactttaacgtgatctttgatcggggacatgataagattgatttgaaatccaaaggaaaataaccagacttcattcaatgatgggtccgaaagtacatcattcaactcgaacatatctggttgtcttgaatcaccatcgaaaatgacactttttaccactttaaaagggctataaactggtgcggtagcagcaactggcgctgcagttgacacattccgccctgaacctatcgttgttggaacaaccggcttactatcggattttgtccccaaggtagcccaatgagatcgtactgtatctctcacacccatgtcacaagcactcactcaataacttctacggcatataatccaataccaatatgttaattctgccttgaacttcgcaattcatcttccctgcaactctttagcttctaagttgaactattaaggccatgtactggatcgagtagatccacgataacaaaatcaacacaacacgtgatatgtatatttcacgtgacttagtgtaaaccccattacactttttttcccgagggaatgcacttttgtcccacaatcggggcggttcaccgaaattataacaccgacaacacacacaattgcgcatgtcctgcaaaaatttcgcaggataaaacaggatgcactattttcacactagcatatctgtcgttttgtcataattgtcattttcgtcggttcaacaagttgcatgtgcacttatttttacatcatgattcacatgatttgtacaatcgagtcgcacacaattacggtatgaaaggtattaggttactgaagagagtttcagaatgacagttgtgtgcgagagttctcatatttgattttttcacaaggtaaacgactggtagcagcacatcgttctttctatctcgaagatgatcggtatttttcactgaatatagtgagaatcggtcatgcgtatatatatatatatagagttcgttcagtataggtataactttcacattacctcaagtttttattcatttggtaccttggtatgagtaagtgctgatacttaactaagcaaacttgtttggagtctagcagctactgttgatattagactgactatcatccattatctcagctggattcataaattcatttattactcttaattattatttgtgatatactctgtctaaagaagaatcataggtaccaccaatagaagatgagaatctctcagaagttacagcgagcgcatgaggagcgcgaggatgctacgttctcgttcgagttctttgttccaaaaacatctcagggtgtccaaaacttatacgaacgtatggatcgtatgtatcagacccaacctgaatttattgatatcacatggaacgccggtggtcgtctaagcatgctttccacggaccttgtggccacatctcaaggtgttttaggacttgagacgtgtatgcacttaacatgtaccaacatgccagtgtcacagatcgatgatgctttaaagaaggcttacgatgcgggatgtgaaaatattcttgcgttgagaggtgatccacctatcaattctttaggagaagaagaagaatggaagccttgtgaaaacggattcagatacgccaaggatttagtttcttacatacgtgaacaatacggggaccattttgatattggtgtagctgcttatcctgaaggtcatcctgaatgtgactgcgatgacaaactgttgcttcatttgaaggagaaagtggactgtggtgccgatttcatggttactcagatgttttacgatgtcgataaattccttgactggtgtgctagagtacgtgaggccggtatctccatccctatcatcccagggattatgcctatcacatcatatccttctttcattcgtagaacgcagtggtgtcaaatcaatgttcctgacaatttcctcgaactattggaaccagtgaaggatgacgatcaattggttagagatgtaggaacagagttgatggtagaactttgtcaaaagttgcttgattcaggttatgtcaaccatttgcatatgtacactatgaacttagaaaaggcatcattaatgatcttggagaaattagatttgttaaagaggagtaacgttggtaaggatgtcatagaaccattggaacctctaccttggaggaaatcgttgaatccaaagagaaggaacgaattggtccgtccaatcttttggcaaaaaagaccatattcatacgtcgcaagaacctccttgtggaacgaggacgaattccctaacggtcgtttcggtgactcttcatctccagcctacggtgatttagatctttgtggtcattctttgattagacaatctgtaaagaaatccatcgaattatggagtactccacagaccttggatgacatgtcaaacttggtaacctcgtatttggaagggaaacttaagtgtttgccatggtcggatgttccattgaaccacgaagttgatgacattttgaaacatttgatcgatcttaacaaacaccacatttttaccattaactctcaaccaaaggtcaacggaaaaccatccacagatcctgtggtaggctggggtcctactaaaggttacgtttaccaaaaagaatatctagaatttttattaccaagagaaaagttaccattattccaagaaatttgccaagaacacagcgatcatctgacttacttcgccatcgattctcaagataatctagcgacaaaccatccagaagattcaagagccaatgccgtgacttggggtgttttccctggaagtgaaattttacaaccaactattgtggaaaaagcgtccttcctagcatggaaggaagagttcttcactatcttgaaagaatggaaattgaccttcgtggaacataaggcaacagaatcggtaaacttggtcaatcacatcatcgacaattacgttttgatcaacgttgttgataacgatttcatttcaacgaacgacacaatctacgatcttctacagcagttgtactagtaaattgccagcttatccccacctctttattttttttttcttcaacttttggttggtttaacaacacactctttgcatttcaacatggttaatattaattaattcaccacacttgttcgggtttatggtttatgattttttctgcatttcaacaacagcatataacatcgcaatattattctacattcagagttcaacatttctgaataaaaaatattcttgtttcaacaacaaatattacacacttgcttctttgtgactcctcggtaatgtcgcctgtaccttttctgtatatacaagtgaattattcaccttaagaatacacacatttatatattgctacatatatatatgtacacgtatattgtcattcagtaagagaaagaactatgtgctaacatatcatgtccaatttcgctgttgaattagcacccttggctacaacttgaaactattacttcgtaatttgtgtaagctgttccaatccgaaatcaccgtgtggctatagttacagttcccctaatctcgcatttcatttttttttccacagtatttttcggttctcatttatttatgtgaacccatgcaccagtaaagggcttttccaaaattaccgatttgaatgtcgagaaagtttaaatcttcatacaattcatatgaagtttagcattgaggaccagatcaagaaagagagaaaaggacttcttcactgtttctgaagtgcgtctgaaccccccttttaagaatttatagccaaaccagatataatagctttcaccgtgctagctgctgattgttgtacttttagagctgccagaacaaggtgttcgaatagacaatatccgaaaggtttaattagcctttaggggttctactgaagagaacgaagaagttgagaaaagtgtaaggcggggaagggaatatctgaactttcctaacagctaaaactgatagaaggcgttacattgtcacttgatatctaagtgaccagtgtaactttttgaaaagggagaaaattcgccaaaaacccacaataacaagaacttgggaagcattcaagcaagactagtcaactagaaggcatttagttatgtctggtttacctttatccctacaaatggagcctgttgttcacacgtcgtctacacctgtttctgtgcgtgaacgtgagcgtggtcagccgcagactaatgttaaaaatctgccgagaaaacacaaatcgaagtctataacagctttaacaagctcaagctctccagatattaaacagccaagtttgaaatggaatgtactaccgaaaattggtgagacgttgcatcaacggaaacattccatgaatgtgacatacacagattcaatgcatatagcgtatgatccaaggtacaattctagattgagcaagttcgatacatttattcagtttaatgaacaatgcgagttgtctgatgtgataacaatggccccaacaaggcttgagtcctttgtcaaatttttgaattattattacgaatcgaaaaaattcatgactaatactgaagaacgagctttcgaaacatcacattatcccggtacaattgatgggatcaattttctcgaagttgattatctcatacagctatggtacctacaatgtctccgattcttacataagactcaatcactttcattttcccccaacattgtgcagtcacttcttcagcgtcgtcaacgtgcaaaacatagatctgtgagtaatgggtttgttgacccagatatcctagttataaggtctaacatgagtgactcgttctggggctggcaagttgcatacgatgagccaagtctaaatatcgtagactacgagttcgaagtctcaatattttcgaaagctagtcaagatatacttgctctgcctatgtgtgccacattgagtgaattgaccgtcaaagatgttatgggaagatcaacggatgatttagaagacggtattagcccaatagattcactcgaacaacaagaacgtagcgattctgatgtttcatccattactgccgattccgcgggcaaaaattccataaactctagaaactcctctaccacttcgaataagttgatgaaagccgcccatgcaggtacatcgggcttggctcatttattcaaaaagaaaagtagtactgcactttcgacagcatctcccacattagacactataaccactactgataccataaacccaacaactgcaatatctgattctggtacactaactctaaagaataaatggttagaaaattattattcaaaaaaattatcaaactattcaagtgtacattctccttgctgttatgaaactcctacgtctactcctctcgaagaaggttttgacgagaagaaagtgctggagtataaattacaatacctgaagatcaaattaccttttcaagacaattcaataccttcgatgttgtgtccaaatttatggtttcatttaagatttgatgaatggaggtccgttctgcaagaaatttaccgatgcttagtaccaggcggttcgatacaaacggaaaattttgattttaagggatcaagcattgatactgacgatgaatgttctaatgcaacaacatcagagttcaggaaatttttggatgccgcagcgctggaagctatgaaagtgaacatccagattttcccaatgagacatttagtacatatgttaaatgaagtgggatttgttaatgttaaatgttgcattttaagtttgaagcgtggtgacttggttaataacttagggttcatgtatgagtttatggcaatgtgtcattacgattcaatcgtcaaaaagtacttgtccgatccgtcgttatacccagaagatacctatcctccaacatttccaatgcgttacttcaacgagcatatcaactccgtcgacaatcacgttggtgcacttagaatggtttgcataactgccgaaaagccactacgataaacttttaggttccgtacatacttttttaatatttacaggagtattttgcattaaattaatcgttaattaactgtcaaatcctttgcaaatgttcatgtttttttgaatcgtaatcgcattattacataaaatacttaattctccatcttataagactttccttttttttccaaagttccaactctaccaaaacgtttatcaaattctttacctagctgttcatcctccttataaacgtcgatcacgaattggtcttgttcaccgcgagaatagtatttggcctttactttagtacttagcgaatgttccttatgctgtaatgccttcacagtttcttcgttaaccagaacataagaaataccagagtctggacattcgtagttcacattcaataataatctttccattatgcctcttaaacctcttgcacctgttccctcttttaacgcaaactgtgcaacacgcttcagagccttttctgtgacacctagtgttacgccaaactgtttaaagatgtactcatactggtgtaagagagcattgcgtggttctttcaagatatggaacaaatctgtctgttttaatggttctaaagcagttacgataggcactcttccgattagctctggaattattccatagctgactaagtcacttggtgtgacgaagttcaatgcagatatggtcttaccgtcaccgatatcgatgtgttctatggtattagagaatcttagctttttggagtctgattctttatcattggctgttgcatctgggtttttaatgcgctcaatacgtttaactatatgtttatcaagaccaacgaaagcacccataagcatgaaaagaatgttggacgtatccacgacgaaagtttcctctttcttggcagctgtttgattattcttatcatccttctttttattcactggacgtttgagagtcaactcaacaccatgtccctccaatatcttcaacaatgattgctgaacaccttcccctgaaacatcttttgtaccaatactagctgcgggtttggcaagtttgtctacttcgtcgagaacaatgatacctttttcggccttggcaacatcgtagtctgcatttattaataacctctctatacaaacttccacatcttcaccaatataacccgcttgggtcaattgcgtacagtcagtgatagcaattggaacatcaagcatcctcgcaagggtagtcgctaataacgttttaccagaaccgctgggtccaaccaccatcaaattacttttagaaagttccaaatcttcgtcatcgttgtctagttctaaagacagctgacgctgtaagttacgcatgccttgttcagcttctgtagatgtgaattcaattggggatgtgctatctaacttcttctgttgctcttcgagtaactttctctgtaggcgagcttctagcttcttctgtttgtcattgactctcaaatagtgattatatacagcaacactgcagaccttcttcccatcattttgaccaacaatatattcgtcaagaaaattctttaattctttaggtgatggtatcttgttctttgaaccatggatcagtttagatgatgcactaaagcatatcctactatgactaaaattccttacccctagacttagcatcctaaattcaagtacttgaatctaaagaaatcgataattatagtgacagtccttaaaattaatatcactcgggtgcaacagaattaaaagactgctggagtaaagttttgtggctttcttattcttcttcaacaatcaccaaatagctctttagatcatttcaacattaaacatgaatttttcaaaggtttccattgaagacctgaaagagaaggtgcgcgatgagaacagtgaaaagtataaatagagagcaacagcacccaagtagtactttgttcttatcattggaaattttcgtgtatagaaatagtagtattctctatgatttgacgtatattgccattcaacactgtgtccgttcgcaatatttttgaagataaaccaatcgacactccaagaatcctggaacaaatatccagttgagagggcctgatttctatttgagaatatcacactaaccactattatgtctaacaaacagcatcgtgtgccagatttttactgttcctatttactaagatcaattccgaaaccaaactcattttacattgggtcctctcctgacccggtgcgacgtctgcggcaacataatggtgcagtacgtcgaggtggtgcctatagaactaagagaaacggaacaaggccatggaaaatggtatgttttatatatggattcactagtaagattgctgctctacagtttgagcatgcttggcaacatagttataagacgagatttatcgagaacaacgagagattagtgacaaaaaaaaataccagaaatggtattgctactaagttgggtaatgccaggcttttaatgaagcatccatactttgataagatgaatttacatatcagattttttgatagattagcctgggaaagttgggagttgaacaaattcaaagttgactacggattgtcactgtgcgaagtcgatgaggctgttctcacagatgagtcacagttggatgagttggacgagttgaatttagaaaggatcaaagccttttatgaggatcaaatggcccaagaatcttcacttttgcagagatatcaggataacttaacttacgaccaaaagagttgtatgatatgtgacaagaaaattgactatatacacgatgaaggtacacagatggtaggattctgttcggatgatgaatgtgattttctttcatgcctaagctgcctgtataaagagtttactaaaaactcaaaacaaataataccgaagtctggacactgtcctaactgtcataaatgtttggaatggtcccaaattgtaaaatactccactgttcttcgagaaaagctaataaaagactgagtatattattagatatttagttcgggtctatagaatgattttccagtcctgtcctatttgaataccagggttcttgataacgtgactgtgatcttcatgaataacttcgatatttgttctaatatcgtccagctctaaagtacacgtctccgcaacttttccatcgggatgatgagcgataacaattttctcaatagaaatgtcattgaagaaagatgaagtatccttatgtaatactgtcccatatataacgtttttgttatattccagctcgacctccaaaagtttcccttgtttgtaagcaaatgtctccccatcatcgacatatagccttcctttagcagtaccatatgctgttggtgctatcacgagcgtgtagggatcattttgcatcaatcgtgatgatctacgatattgatcttttctggtgataatatgaccgcctgctatgtacgctggaagtttctccaatggtgcagaaacagtcttagtttccaaagttccgaaatgtgcgatttctagattttgtaaatcatagaagactccactagggaatgtgatggggatagatttggtattagcagaagtgacaggcttcaccaatatgccctgttcacccaaatagaattggtcatcaatgtcgtagaaatttgccacatttggatgttcatagatcattggattcataatgggaattcctcttgaatgtgaatcgtgaaaggctgtgtatagcgtcggtagtagttgatacctgagtctgataaattcagttacaactgaccttgttcgctcgttcaataaaaatggttctcgtcttctggtgtctatatgtgcgtgggctctgaaaaatggataccatataccagcctgataccaacggatcaatagctcgtcatctgggtttccgaaaaagccagctatatcagctccagttgcaggcattccgacaatgttatgactcaataccatcggtatggacaattgcaagtattcccagttagctacattgtcaccggtccatgtagctgcggttctttgcgatccagaaaagaacgatctagtcaagacgaacggtcttttgttcgggttcatatcaacaaaggaatcataggtggcctggtgaacagttagtccatacaagttatgcactgacctttcttcgaatccattataatgaagaagatcctttggggctgtagtttccggcccatcgaatatcgaaggctcgttcatatcattccatatatagaggttcgatggcgtagaaataaaagtttgtacaaattttgaccaaagtttgcttgctaatggattgaaagtatcaatccaaatggattccccaggccaacattggccaaaaaacggtttgttcaaagcgtttcgcacatatactttagcggctattatggcttcgctaatatgatagtttgattttatatgcggatcaatgagtgtaaccaaattccttcctaagaaagctaattttgagagcattctagttggattcggaaaagcatctggcttccaggtaaaatattgcttctggtctgtgtactctaaatctaaccataaaaagtcgtagggtatctgccatttatccatcagagaatccacggtgagcacatccttttcatcattgtaattccatctacactggtggtatccaactgaagaaagtaaaggaagcattggttttcctgtaatattaacatatgactctgtaacaagttttggtgtttcctgaacaattacaatgaaatcaatgatacctgattctgacatccaatgagtggaagagtcgctgtgtccgtattggatatcaatccaggtatcagatgggttcatccaaaacagtccgatcgacagtgactcttttatcccaacaacgaaggggatagaaccatacataggcaatgtggaattcaacttatactgaaaaacatcaacattgtaaagacgataagggtcaatgtttgatgtgtcacgtagtctcaaagaatctgcatgttctgcgataccataaagattagatataccatgaaacttaaagtctaaggctactgattcaggaccaagcgggattgaatcagattttgagtccgcaaagctatctttaaacatgttgaagggctcttcttcttcgttgatgttctcgaaattttcttctaacgttctataatgttcaaaatttagcatattatcgctgtttaccgttagaacatctgccgagtcatatttgacgtttatttggaagtcttgagaactcaacgttactgtgaacctatcggccgtgaaagtgaagtcctttttattccaaaaggtgggtgactttgcaataacctcttgtctgataggtatgtagtccggatcaaatgcccaatgttcagtctcattgtacctttgtaaattgataccagctttacctagtttaatgcttctatgctcatctaacctaaatcttactttatcgccgtcaaataaatccaaggtaaaaggaagaggtatcttgatatctttttggttagcttttatgctcttgataataaaaccctgtatagtatgattatttgtatcaaattccaagctgccttgatcgagactataatgactgttcctgctttcttggatgtttttagcgtattgtctgtttctatgacagaatcctgattgagagcatttttttagcaagtcatcttgaaatgctaatgctatcccaaaacttagtaaccaacgtagtaatgtagatagtgatagcttcattctcgaaagctttggcggccaatgaattcaggcaagctatgatatgtgctctttaaatgaacagatgcttttaacggttaacgtttcttaatataaactttttcctttgatatccaatgtttacactttgcatgctgacagaaaaaaatacgtaatgacatttactaaatggaaaagaaaccgttaactaaacgcagaaatggtagtggttagtcttaaactgcttcactatttgaccaatgcttaacgcatactcctcttacataatgaattactgttttcatttaagcctctgagtctcatatttaggtgttcgactcacgcggtaaacatgccttaatcaactgaatgaaactctttactgtacttcgtccatggtaaagagaaagcctcgagaaacacacatgagagaaatgcacttagatgctactatgaaactttattttatctataaatatagcctgtaagaaaagttcttaatggataccagttaatggccgagttatcaccgtctattcgattcgaacaagaccaacaagtcattggtttagaatttttgagagttttaacttggtaatcatggaagtagtagccacgcttgcaccaattagctgcgataatgcagagcaggcaaatttaccaccaatcaaagacgttttgggcgatattccaattgttagttcgcagatagataaactcagaaaagaattaaccaggaacaaaacggaactacaagcttcaattgctaaaatgaaagccttgattgaaaattttgactacgagtccatcgtagcgatacaaaaagaatgccaagtcattagagagttcactaataagattagaatgagaatgattaaacatgattgcattgacatccaaaataatagtgacatttacataaatgaaattattccaccgacatggtttgaattcaaaagggaaggtccaaagtattgcgttcattgcgagtgtgtggagactattgaatggcgtaacggtccgtggggtaaagcgactttgtgtaatgcatgtggtttgtggtatcgcaaattgaagaaaaaatttaccgcagaacaatcagcaataataatggaggagaaaagactcttttccaataaacatgataggaaagagttttctaaatttgatgcagatgataaaagactaaagatcattaaggactcattgattgaccggataaacaaattcataaaggaggtagagttatgcaagagtactgctgccaagctaaagcaaataaaagcaaaagaggatatggatcagaaagtgacacctcgggaaataaacaagtacgattcaatttctcgtatatgttgaatgagcagtttagctgacttcaaaatagattgattggaaaggtttatatcattcaacaagatatagagctcaaatttttcagttgcccagtatacaccagataacaaaccaggagtcgcatcatttttccacttaagcattgcaacagatgacttatttaagtttgtacccttatcatcttcacaaaggtttttcaaatgataataaaattgtaacatttcattagtcggttgggatggtgtgtatatctgtacagttcgtttcatcttataaatgaaatgattgatgtacgggaactttttatgccaatccaatagctgtaattccaaattattacaagtgttatcgtctatcattttgtcctcgattcgccgtacaaattcattcaatatgtcaaaagcatttttttgagaacttatcaccatcatgatagtattgttcggtaacactttgatcaaagcatataggaatccattatcgttgaatttttggaaacatattggaaaccacaaaactttgtctaataaaagatcagtaagctgagcacgcactacctcaaataatatttgcaagtccatagtatgtaaagtgtggtttgatggtcgaagaattgatatcaatctcatatctaacgacgtaaccaaagtgtaaagaatctgtccgttatggttcgatatattaaagtccaagtaggtcgtcgacaagatagaatttattgcatttctctttttaggagacatcggcagacattctagactattagcaaaccaagttagtttcggctgcgtcgcgagggattcacaaagtgatttcaataattgctgatccaaatccgttagataatgttgtaagtcaaagttggatcttttcaacatcaacttgttcaaattcctttgagataccgacgatatgatatatgaataaacaagatccaattgttgctgcaactgagctgtggattcataattattattgcactggaccattaacttgatatgatttttatctaagaaaacaaatcttgtcattatcccgtccttaccatacatagtaaactgtctcattgctgtattgtcattaatattaaaataattcatcacggtatggataataccagtaagacccatagcatgattctcattttcccactgcgagaagactaatttaccagctgaagtaaacacgaaaaaatgtttatccttgccaccccgttcgtcgataaatttggtagtattcgcagacttattggaagtttcttggtttaacgtcaaagggtatagagaatttaactcagaagttatcaaagattgtaagtcaatattcaaatcagtgtccgcactgatagaatgatcataggtcgcggccagcaagttgggatcatttttggccttaattgatgctgtggttcctgtatcgatgtcttgataaaacagcccaccgcgagcactgagatggtttgtcaggtcaatagaagtagttggtttcgccgaatttttcgtactaatttgaaacgacggagatctgcgcattatggtaatcaacgtagtcgaatgcgatcgggagatcgtccacaatcagttacttaactcctctggtctccagattaaccttttattattcaaaggtttttttacatgagctttttgtatgactatttttttttttttttttcaaggtctgatgattaagataatgaagagaaaggaacctgcaaggcaatgacatccaagtcctggcgtgaaccagtttccgttatcaaagaagtgagttttacatttcaaattaagaaggaatatacataggatagaataaggaaaaagatagtgttatatatatatatgtagaagaataatatatatgtggagagaggtcctaattttatattcttttttttacttcataagaacgacacaattttagaaagcatcgtctgagacaaaatcgtgactttttctcttcaacttaaagagaatgaaatagagagatgagatgacgagttaagaagagatttggagaaacaagttttccacaaaaataaaaaaaaagaatccatatcagtgtctcttatcgaatcttttgtaattgtagtaactgacgtaggcgtctgcagcaatgaaggcactcaaccctgaaacaatcaaagcgatatccttgtcagacttccccttcaagaaacgtcttttgttagcatatccgtttagcaaagttgtaatagaggctgcacctagcaaagtgttgaaagcaactacagggttttgcaattcatgcaagacaatagtggtagccttcgaagtattagctgcaacggtagaaacagtagcttgagtaacaccaactgtcttgctggcgacagcgttgacaatttcgactagcttatcccagtatggtttcaagattccttcgtattcatcgagatgttttttaacttcgtcatgagccttatcaacggcatcatgggcatcatgagcagcatgtgaagccttattcttagcggtctccttggcttccttgacgtccttagctgccttacgtttttcttgctgctggttgtggtgttgagcgtcgtgtttttctgatgacatttttattttctgttgatacactgatacgtttgttgtgaaactgaatccctaaagagttgataatagagagaatatagaaaatgttaaagccttaacaaaattgtaacgatagtttaccttattttaatgagcactattttttttcggctttttctgtctctttatattttcggggttgaatttatagaaagaaaaaagggtaaactgattatggtatttctgtctaaaggaactattaaaaaaaaacaccggtatgggctttgattctgaactgatttgaaccaaactttgaacttttcgatttggacctgaggttactaaactaagacaatcttgtggagaagactcaaacaataccctactagtagtatcgcagttatataatatcgtacttttcagggatatatcgctacttaaatatccgtgctcagaactgatctagaaaacaaaaaaaaaaaaagaaaacgggagatcacaatcacaatcacaatcccaatcacgataaaagctaaaagtcgaacaatgatgaaatgtcacagtgtgacgaagtgtaactattggtgatgtagtgtgagtgcttttatgtattatgtattgtaatacggatggagcggttacagccggttcccgctgcgttagtttggcttctctgttccacgtttgaacattttctttccaagatgctgagaaggtgtgcggcataaacgtcatttacgctggatagcgatagaagtaatcacttttctgtctcagaagatgaatttgcttctgtctaataggccaattggagtgtatttgctactaacatggcttgataatgttgttaccgtaaaataagggctgttcttctgtatacttttctgtgtcctattgactgaatgtcctgattgcggtgaaagcaaactgagaaagcaaaatgcatgccggacctggggtaacctagggtaaccaaattatatctcctagtcgggatataaattttgtggactgcttttctccattaacacccgtacattcggcaatttcaatttccatcttttttttcaataatgatcgccactttctttaataggaaatattgacctttaaacaaaactatcttgacacgtgatttatagcctctttatatcctcttaccctgccagtacaatcaaagtttttcaaaggtttctagcttcacaaccatgcaaacacgtcggatatttttttttcacacatgagacctatctatctcatcactaaacaaagctgcatcttaccaaacgttaagtaatttaattttataatctctatttgtttctccttcgaagctccccacgcattgtatttattgtcgattgaaagttacctatccatcaactttccgtgatccaatcccgacaagtctttattaagtacaattcgataaatcaaagatgtctgctccacaagctcaaggtcaacaagctccacgtagaggtggtttcggtggtgccaacagaggtggcagaggtggtagaagaggtggtagaagagaccaagaagaaaagggttgggttccagttaccaagttgggtagattggtgaaggccggcaagatctcttccatcgaagaaatcttcttgcactctttgccagtcaaggaattccaaatcattgaccaattgttgccaaacttgaaggatgaagttatgaacatcaagcctgtccaaaagcaaaccagagctggtcaaagaaccagattcaaggctgtcgtcgtcgttggtgactccaacggtcacgtcggtttgggtattaagaccgctaaggaagttgctggtgccatcagagccggtatcatcatcgccaagttgtccgttatcccaatcagaagaggttactggggtaccaacttgggtcaacctcactccttggctaccaagacctctggtaagtgtggttccgtttccgttagattgattccagctccaagaggttccggtatcgtcgcctccccagctgtcaagaagttgatgcaattggctggtgttgaagatgtctacacctcttctactggttccaccagaactttggaaaacactttgaaggccgctttcgttgccatcggtaacacctacggtttcttgactccaaacttgtgggaagtccaagctttgactccttccccaatggatgtctacgccgactacgccactgcttccaagaagaagttgtaaatgtcatctttaaaatattataactgtgctgtatagatatttttttatagctgtcagtatgttttctctgaaacaataatatattgttgacattttaccaattgttcctcttctcttcacaagctacatatcatatatattcacactcattataattgaccttaaccctttaggatcgatcataataaatgatcaatatacgtgacaaactaactaagggaaactatatgactgtcctatacacttcgtagcaagaaaaaccagagaaaaagacatatggtaaaaaaaagagatagtgataaaatcaaggtaaaagggatttctcttatatgaccattagagtacaggtcaagatacgccaatcatattaataggcttctggaatttaaacactgccagtctcttttttacagtagtctttcttccggttgaccttttttttttattactttacagtatttttttaccttttaagactttttttttttttaataattaatagatataacactataataataattcaaataaaacagttaaggatatcaccattaaatagagcggagtagattggaatgttaactcatcatcatagcatcgccatctacttcttgtccagcatgaactgactgtacgttagattctggtacagcaaatggtctctcgttactcgaggaatttccacttccaatcagctgcggattgaaccaaataccgttggtgttttctgtatcaggcttttttggcttttcaggcaataccctttctggaggatgctggaataaacatccgtatgttctacattcagccccgtacctacaaggttcattgatagggtgaccgaagaggcagtctattcttgtacattgcgcaccctcgcggcacatgattgacgaccttgcgtgtctctttggacaatttttattggtacattttggaccaaacttacattgttccaaaatcttttcttccaatgggacaaccgatcttggcgcgaattttggattagaaggtttagaaatgaccggttttggtgctggcttgtgtatgattggttttatttccttaatcttggataaggaactgtgagccttgttacaggtcggatcagtgcattgcaagttgttctcgcaccaactgaattgggtaacctttgcgtcttcatttgcaggagttggatgaccaaatggacatttttgattagaacaaatgatcccaaatttacatacaacaataccactgatcctttgctgttgtttcttttccatctcttccctctttatcctgcgttcttctcttacacgctctagttcttgtattaattgtccatcttcatttggatgtaaataagtgcatgtacctggtggatttttacagtttggataacttggacacgtaacggttggatgtccacgagggcacttccttcctagagaacagtgagggaaatcaggacaacggccttctctcttgatgacaacatggccagatgtttcatttgcgccttccgattcatttattccaagagccatcgccagttggttagcaccgtatctcgagttaactccacgtctattggtaacaccagcactctttgaaattccacctctaatggagctgaaaccaccacgtctagaagtcccattatgggccgatgaatctttgttacgttgcgaagacctcccttcgttagccgtattatatttagatgcagacacatctactaccccgctaaatgcagaaaccggtgcacttggagctggagcagaaacgggtggtgactgtactggtactcctacagatgtttcggttccagttgacacaggtgcagaaggtgcacttgaagaaggttgagatgaattaccactcaactttgcataaacggtgttcaagtcatcgcctgctttcaacagatctgcagatgtaaatgcaatggagacaacactctggaactcttgcgtactaataccatcaaacaaacttgtcaattcttgtacgatatcaggaccgctggaaccgttggacattaaaagtgtaatatactcagcgacttggttaacatcttcgttgaaattaggaacaacctttaatctctcggagatgacagtctttaaattgctggcaatatattcaggtacagttgacatgttgctactcttggtttgtgtcctctttagtttgatcaagcaacaaaactagcttttatccttgttcaaataactgctaaagaatcattcagattattcgtaattaatttcgttttaagtatatgtaatcttgttcttccttttcttgtaccagcccgaaacaattttttttttggctctgtatacggaatatcgtagaatattacgcagaaggttgagtggagaaaaagaaatcagaacgatgtcctctgctatccgagctatcacgtgattcgttgttaactcctgtattatatgttagttgctatatgatagtgacagtgaatagaccctgttccagttttaggtagagacctggatcagtggttgatgagcattagaaatctttctcatatttataaaactgctagtagctttctctagggaagtattcattatttagaggagttaattattgggtttccatgtggaaatgcagaatgattctatgctataatttatttattcgtgatgagatgcaatgcatataacaaattccgtcgaaatttcttacttcatatctattctttagaaaggtattctttagaagtgtctcgtagttttgtcttcttgtctttcatgtaatttattacattgttaaatgttatggtcgtaatgcttttaataagttcctcgtattcctcgttgatcttggtaactgcttccgacttttcctgcaattctatctggaattgttcataagtgaaaggttgcaacgatcgttggtataaattcggatggcgttcacaaaggtcggcaaatagatgaagagactgcaaaagaagacttgctaatgtgaggtgtagagagtaatccccaagacttctcttattagataccgacaggttgtacatttccggataaatagttatcacttcgttaataatatcgatagcatacgctgaaaggatattgagtcttatggctaatccatccaaagtttcatccctaagtgcttcctttatcttctctactccctcagttaaatcacctgcaagaatttggtatgcagagagtacaataggaagtatttgcacttctaactctttagcccatctgtttatatttcttcttgtagccaaaagatcatcggatgccttggaaaacaattcgtcatcatgctcaagacgtcttctttctgagtctattcgcatgaaggcgaatataaattcgctgctgatttgctccgcaaaagtaatttctcgcgacataaaatgtgcaaatcctaaataaaactttccaagatctattacatcgttcttcccatcatacatcaccaaaaaaggatacttcttcctcaataattctgttagtttctcgctatccagatggttagcagaacttaagttgttcccactcattattttggtacaaataaaccagtgaaccaccccgatgtgattataggctttgatgttgatatacacccaataatgaaaagtaaacgtgcactttccactgttaacttctattatagtcatcctcggttcaaaatacattggaagcatcttagtatggaattgatctccagtcacgtgaagagaatcaaatccgtttacagtgatatattctccctttaacctgaatttttcaaaatttagtaaaaaaaaaacgcgacgccaataatgcatatattatagttttaaattgaagagtaacattaataatttttgcaaactatacccattgtttaagagctggcaggaaattaaagcaaagggactctttggtacttttattgaaataacctgcaaagcatttcgtggctcggtatttcaaactcattgttctattaggcgtggcagttgtcttttttggttagatattgaggaccccattgtgctaatctcaagtaacaatgagtgacggaggaattgaaattgatttccaagccttttatgataggtttacaaaattagggaaggcatattctggatttgaaggttctccaaatagtcttctctttgtacttggttcgactaatgaggaaaacccttatcaaaagaccaccattttgcataattggttgctagggtatgagtttccagctacattgattgcctttttcaaggataaaggtgtcatcataaccagcagtgctaaggcgaaacatcttttgcccgctgttactaagtttgaaggatcagattacaaacttgagatctggcaaagaaataacaaggatgcaaatcacaataagaaattgtttgaggacctcatcaagctgttatcagaaaacggtaatactgtcggtgtcccaacgaaggattcatatcaaggtaagctcattcttgaatggaaaccgctttgggaagaagctaaaaagacgcattctttaaacgtaatcgattgctctgctggtttgtcttctacttggaagggcaaagatgataaggaaaaggcttacctttctgtatccagtaagggatctgacaaattcatggatcttatgtcaaatgaaatcgtcaatgctgttgacgaagaactaaaaatatcaaattctaagttgtcagataaaattgaaaacaagatagatgattccaagtttttgaagaaactttcaagtgatctaaatcctttgtgtcctaccgacgagaaattcgacgttaatttccttgattgggcctattctccaattgtgcaatcaggttctaagttcgaccttaaggtttctgctcgttctaacaacgactcacttttcggaaagggttccatcctagcctcatgcggtatcagatacaagaattactgttccaatatcaccagaacttttttgattgacccgacagatgaaatgactgacaattatgactttttattgattttgcaagagaagatcatcgatgatttattaaaagtagaagctgatccaacatctatttatgaaaagacactggaattcatcaaagaaaagaaaccggaattattatctcactttactaaaaatgttggttctttgatggggttggaatttagagactctgctggtatgatcaatgctaaaccaaccgctcataaaatttcagagaattgctgttacaatatttcactcggatttgggaatttaaaggatagtaaaactggtcaggtatatgctgttcaattagcagataccgttcaactttcttctgatggaaagccatccactttgaccaagtacacaaaggctagatcccaaatctcgttttacttcaacaacgaagaagagaacaaagctgcaactgttaaatctgaaaaaagcaagcctcctgctttaccaaaacctgatggtacatcgaagattttgagatctaagctacgtggagaaagtcgtgctgacgatgaagagaaagaacaaatccgcaaagagaaccaaagaaaacttcatgaaagattacagaaggaaggtttactcagatacagtgatgcagatgcagtagatggcgatgagaagccaaagcatttcttcaaaaagtacgaatcttacgttagggaaactcaaataccatccaatgtacgtgatttgaagattcatgtcgactggaagagtcagacaatcattctaccaatctatggtagacctgtaccttttcatatcaattcatacaaaaacggttctaaaaatgaagaaggtgaatacacttatctcagattgaatttccattctcctggtgctggaggtgtcggtaagaaaactgaggagttgccgtatgaagagaacccagagaatcaatttgttcgttctctaactttaagatctaaggatggtgctcgcatgagcgatgttttcaaacaaattactgatcttaagaaggaatctaccaaacgtgaacaggaaagaaaagctttggctgatgttgttgtccaggctaaattggtggagaacaaaactggtaggactaaacgtttggaccaaatctttgtcaggcctagtcccgataccaagcgtgtgccaggtacggtgttcattcatgaaaatggtatcagataccagtctccattgaggacagattcaagaattgatatcctattctcaaacatcaagaatctattcttccaatcatcaaagggagaacttattgtgatcattcatgttcatctaaagaatcctattttaatgggtaaaaagaagatccaagatattcaattttacagagaagcatctgatatggctgtcgatgagacaggaaacagcagacgcaacaacatgaaatttagaagatatggtgatgaagatgaattagaacaagaacaagaagaaagaagaaaacgtgctgcccttgataaagaatttagatattttgctgaagctatagcagaggcatccgatggtctcctagatgtagattctccatttagagatcttggtttccaaggtgttccttctagatcagccgtgttctgtatgccaacgagagactgcttaattcaattagttgaaccgccatttttagtcataaatttgaacgaagttgagatttgtatacttgaaagagttcaatttggattgaagaactttgacatggtctttgtttataaagatttgacaaagcctgtttctcatataaacactgtaccaattgagcaacttgaattcattaagacatggttaacagatgttgatattccatatactgtttctacaattaacttgaactggtcgacaatcatgaagtcgctacaagatgatcctcatcaattctttttggatggtgggtggtcgttcttggcaactggatccgatgatgaaagatctgatgagagcgaggaagaaatttcagaatacgaggcatctgatgaggatccatctgatgaggaagtgtactctgaagaagaagaggattattcggatgacgaaaaattcagtgatgaagggtcagatgatttcgccgatggatcagaagatgacgaaggtgatgactgggatgacttagaaaagaaagcagctaaggcagatcgtaatagcaattacaaagagtaagatttttctgtctctggatagtttatcgttattttgggttgtatttttataagcacataatgtaggcactttaaaatcttttttattgaaatagttggttattctggttggtttatttatctcaacgtaattgcattcttattacatattatacatacggttcatcaaattaacatgacagcatcgaaagtgcgatggaaaataacttactaaaccccctcaagttcagtagttagaaaacccagttgcctgtgagccaatcgcgccatttgtcaaaagtaatggctggtcatcggagttagagcctacttttgcctttgatgcaaactcggaacttaattgcttgatcgcatcattttgctccttcttcacagaaatttcatatggtttaataaatgtttccaagttattcaaccaagcttgttcaaggacagtatcgtatgtaatcaagtggtaacaagaatatagtaaagcgataaatccttctttgttgtcggtttcaatgaagaatgataataggtcttcggcgatctgttgactttgtgaaattgcagcagtttcaatagcatgtttccagagctgttcgcccttgaagatagccaaactcttggcccactttttgtttctacggtacaattcggcagcaataatcttgaagaaaattatctcatgattttccaaacgggtggccaactctagttgatcaaacttatcatacgagctaacagcgtcttgaagagctttgtaatcaacctcttcgatcatcaaatcgtgataagcctgattaactacggagttgttttttggcaagacattaattaagaatggtttaatcaatggtagattgtcagatttggagaaaattctaacagttcttggaatgtctaatcttggaatcaacacggttaataaatcaacaagtagtgaagggtgttccttcacataaaagttgattgctttgtagtaaatttccaagtttgacactttaacaatgatttctttgaagtacgaatggtcaaagttataggcagacttttcaatcatcgttaaagcagcattatcccattcatcgtagtgtgcatacaaaaagatcaattctggccataaatgagcatcctctacagcccttatgacttttggaatgttaatacgagaccagaatagctttaggtgttcataagtcttggatggattgtacttagtgtaaaggattgccaattcagtaaacatacccatatgagctctttccaaacctaaacctgcttcgaatagggaaattagctcctcgaaatacccgttgtgctcatatacagcaaccaattcgtctaactcctcggcatgaacaaccaaattcaaaccacagatttgagccaatctaaattctttattggaaatacatgcgtcgttaacctgtctccacaccttaacattggaagcttttctggcggtatcgacagcattttgataatcacccaaataaactaaagtgctagccaacttagagtagttagaaatagaagagtaacataatttggcagctttgtaatcattatgctgggataacttatcaccaacttcttctaggttagcaacggtagagactgacaacaagttttcaatttcattcaacttactcaattcagcgtatgccaagattaatgctccgtcgattaccggttccttcaaagattctctagccatcaacaaatatgggacaagctcttcaaatttaccagcgtcttcggcagccttgataacgttcatgaagttcgaaggatctttagccttgatgtaagagtcaatagcttctgggatacgtaatgcatttaattctgcagtaccaagttgagaccatagctctggtgtgttgattttgtcggcatatgattctgctctgtctaacatcaaaagatcttcgactataactttcaatgctttgtcatgtttcccatgtttatcataaatttcgaaggcttcttcatttaattcattttcaatacacaatggtgcaatttcatcaacatcataatgatctaatttctcaattaagccacttaccttgttaggttcatatctaatagcagagagaagcaataaaccttgcaaagcaggattgtcattgaaaggagatggctctaggataatcttctctaacaattcaattaactccgtctttaatccgttagacataaaagcctgcacagtcaaagacactggttctggatcagtaagctcaggaatgccaacgctaatgacagcatcaaccaattgacgtctatggatattgtcaggagacaacacaatgttccacaaatcagagtttgaacgagccaacaaatatctggcctgatatttgtacatactattttcgtttgtgattctaatcaaatcatcatcgttttgtcctttctcgtaggcgatgtacgccaagtaagggtccctcttttcacaatagcgaccaacattcaaagtatcatattgatcattctccttcaagaacttttcaggtgagttgtttgagtcaatgtagatcttagctaaggtgttgtagacagactgattttgagtcccagattgtaaagtcttttcgaggaatggtaatagtaacttcaatctgtttctcttctcgacttcagcagtcaattcatcgataggaacttgaccgacgacagtatctaacaatgaggtgataactttctcgtcacaatcaacatccaataaacctgccacaacttgagcagttttagaaggattaacttgttgcacgtacacttcgataaatttgaagtttttggttctgtacaagtataaaaccaagtcatgcaccatgttgaaacgatcgcaaacaacaaccaaaggcatttgatcttgtagttgggcatctttcaagaaattcttgaccttctctgggtcataaacgttgttttcccttacaattctttcaacttcttggaagtgaccagctttgacagcagcttgaatatacttgaaaacaacttccttatcggtagtcaagtttactaaagaagccaagtagtaatataaaccttcgtttgatctataatcttcgaagagtttgattaatacttgagaaccaatcaaatccgagaacttggttgcaacttgaatgacaatttgaagatttgcttccaaattatcatctaacaaggtcttcaaacaggcgagtgattgttcgacattcaacttaccgaagaagtccactaaccaatcagctggaatggaggaagtatggacaatacatctcttgatatccttaatatcagagtagttttccaaggccctttggtataaacctgccttttctgccaaacctgcaatagttggcttatcataataagagaaaatgtcattacccaaaatagcatcagcaacttgaggggcatttaataagttgatttccaatactctcgtttgcaaatgtccttgatcaggagtatttgatcttaaagcgtcaagtaagaaagaagtaccttgttgaatgtaattctgactgaagaatatgtcggcaatcttttcaacttcaagttgagaagcagtttcagggttagataataaactgatggcaaactcacttgctttgtcggggttagttcttaataggttagaaatcaaaacaacgaagtttggattgtatcccaccttggcggagtatggtaaaatcttatcgaactgttgcaattctgcaagacatgcaattacctttggatgtacttccgccttcaaataggttgccaaagccaaagtagtatcaaatggcttcacgatgtcacctaattcttcagagcattgtaatttgtcttcctttaagtacttttcgtataattgatttctattttgttgtagaagtggtcttgtcaattcaatagactcatattgatttagtttgcccttatccaacaatgtggagaaatatagtaaaattggagagattgatcctggaggtgcctggatatttttcaacttgttaattgtagcttgagttcttaattgctgggatgacgcagcaactttagcagcattgctgtaatcgccttgtgataaaaggttgtcgaattgcttctcgaataaatcatcagcacctggtagtccacctctcgaagccattgtcaatgcgagggatacattggacaacttattcaaaacgtaaggaactatttgagtagtatcaatttcaacagccaaaacgttaccctttttgttgatacatgcgataccattcttgtggttgtagtatgttgcagtaaagacagagtccgcagtgattctattgacgaacaagtttgaaccagtctctaactcatataaatggataaaaccgtacttggtcaaaacataaatgatgccgtacttctcagagacttgaacagaaattgggaaatcgttaactgcatcagctggaaagaatatatctacaatttttttctggtatcttactgactggtcttgaggtggatcgatttcaattatacgcaattcgccagcgcctgtgttgacgtttctgttacctgtaacgaagacttgaacgggttccgtgttaccatccaaaagaattttggagaagatagctacgtgaccatcaatggcttgcgagatgcctctagttttcgaaaacaattgaattttaccagcaattttaccattttcttgaatgataccaacgacagcgaaccagtccattttttcattggcgacaaagttgataatttgggtgttgtttaagttaacgtgtctatcagtaattttggctggcttagcagaaacgtttccatcaaacacattggagacgtaaagtgagttagcagtgatgaatcctaacacgtcttcgctcaaccatttccagaaaataactggttcatccaattggaaagatttcaatttggacttagtatccaagttgaagatttgaacgatggttccgttagctctaacagagataactttttgtgaaggatgcatgatggcagagtcaccacccatatttttccttgtgacctcattgccgtttgtcaaatcgacaattgccaccgtgtttgtaccgttggaggactctctaacggtgacgaaatgatcggattcgaaagtggtagatctgaaatctaggtattgaggggagatacctagtgatgttagatctaccaattcagtaaattcgatgggaagatcactcattttggttttcagttttagtttttaggtttaaagtactatttcttccgacttatcttaggataattccacttcaattgaattcgtgtttataacaatctacactgaattgaagcgacttcttcagcggggagtcaattaaagcactgatatacttcaaagggaacagaaatgaagatagtgcaaagattgacacctaatttagctttgctttgtcttttattttagaaacaagtttccgatcggatcgagacaaaaataagaaaaaaaggtatagcaattagctctgtaatacttcgatgtagtttccagctttgacttcaataaaccaattgcagtcaatgagtcgcagtcctgcggaaagatggattaaaagaataagtttagacaatctactttaaaccctttttcctaagttaaaaagtcgtttttaattcgagaactatgaattttcaaagaaagtgcttaattcacttattttcatggaatgaaggtaatttcaattcaaaagatcaccaaacaaacaagatacagaatctggtaaaaagggggagcctattaaacaaaaggaaaacaaacggtacatcgaatatatatgtcatgggtcacaagatagaggaaacattttgaattgagcttgtggcctatcactaatccacaactcagccttactcgttgcttacttgcttctgaatatcaaatggaactagagaatgtcctcggccgggtaataagtattatggttatatacaagcatatatatatatgtttactgcaccacatttttcacgtaacgtgaccagcatattcaaaaaaaaaaaggagacaacgaagttttatatccgggtaacaatattagacccccttttctccaaatccattctgtttgtcacgttacccggaaatgcatcgtgtcattactgacgatccgttttatcacatttctcctcaccagcagttctccctatgtgctagctccgatttcgatttcagtcatcccgaaacttggaaacccctactgcacataatgtgcactcgcaatgaggaaagaatatagaagcagagaaatggttacagaatattaacgccggaagggtatcggatggcgtgggtaaattaagcccgcccagcgaaggcacgcttgaagcatgcgcttacatatccaaactccaattactttattctctgttcattaagctgcgattatctctatcctaaaacactagtaacagctggtgtgatcttctatttaattaccttgaaggcattcagtttcgcattatattgctcgctcggtatattgactagtgctagtttagtgcccttggagttagcgcggattgattagcgtattatctgaatccctgaactttttttttgtggggaaactctcggccatatcatattgtccccttctctggagttaatccttctccttttctttaacgcccacataatgcgtacctttggcttcatttgttctgaaccacgtgagaatttaggcgcctctctttaatttgtatatattctttgtcatgcgtcagcgttttcttaccccaaattatgttatataaaagaactacatcgaaacagttctacaagaaaagattaacattccagtaaaagataatagattgatacacttaaatattttattgatactgagaaccttgcgtgtgtgattacgataattccgaaatcacatatctttaagaaggattacaaaataagataatcaagacaaaaaatgactagacaatctacggtagatcaaaatcagtctacgtataatgccaagaacttcattactaaggaaagacaagaatcaaaattagatattgaccagttgaatgtatttttggaaaatggagagcaagaagcgaaattgacccatgatttgatcgaagaaattatcaatgaccctattttaaagacggatacggatcattacgatattacgaagtctcaggaaagagagattactgcaagaagaattgccaggttatcgctttatatggaacacgatgtgaaaaccaaacaaagagagttcaaagatgatttggtaaaaaacttagaaaggaaggactcgaaattgttaacgaacaaggatctatctatctttgatagaagattatcacttgttgcgaacatcgatccaggtttatccacaagaattggagttcatctaggacttttcgggaattgtatcaagggtaatggtaccgacgagcagatccattattggctacaagaaaagggagctcttttattgaagggtatctatggttgttttgctatgacggaattgggacatggttcaaatgtggctcaattacaaactacggctacctatgaccctagttctgacactttcaaaattaatactccagacttgctggcaactaaatggtggattggtggtgctgctcattcagcaacccataccactgcttatgcaaggttgatagtcaatggtaaggattatggtgtcaagacgtttgttgttcctctaagagatgagaaaaccctcaacttattgccaggtataatgattggtgatataggtgcaaaaatgggtagagacggaattgataacggttggattcaattcaagaatgttgtcattccaagacagttcatgctacagagatttaccaaggttattcctggttctccaccgaaggttcaaacgcaaccgttattggatcagatttcagggtacagtgcattgttgagtggccgtgttaacatggttatggattccttcagatttggctccaaatttgcaattattgcaacacgttatgccgtaggtagacagcagtttggtcctgaaggtaatgaaactcaattgattgactatcctttgcaccaataccgtgtgttgccgcagttggcactttgttatttggtggcacccactgcacataaattgatgggaacctatatttcaaccctaatggaattgcatcaggcaggagcagataaagcaaaattgattaatgttagtaataagttgaaggatttattcattgattctgcctcattaaaagctactaatacgtggttggtggccaaattgattgatgatctcaggcaaacatgcggtggccatggatactcttcctacaatggatttggtaaaggctacaatgactgggttgttcaatgtacctgggaaggtgacaacaatatcctctcattaacatcagctaagagtattgttaagaagtttgctgatatctcacggggtaaaaatactactgtcactaccgactcattaaaatacttgactcctcagtttattggtaagagcttgtccaaggacctgaccttcaaatttgacaacaagaaagatttcacggaaatatgggccgtcatgattattagattgatccaccatgtggtagagttgatttcaaagggtaccaaaattgattcgttatccaaaactttagttcagatttcaaagttccatgcaattcattctatgctcttgacataccaagacaagttaaacaatgaatctgaagcatcagtaaaagatgcttacacgaaaggttacctatggaagctatatgaattgttttctttgtatttcatcgatcaacatcttggtgaattccttttgttgaaagttgtgacgtcagatcaaatgtcacaagtgctacagccaagattattgcaactattacctgaaataaggaaagaatgtatagcattgacagatgcctttaaactaccagatgcgatgattaatgcccctatcggatattacgatggtgacatttatcacaattatttcaatgaagtgacaaataataacaaacttgaacctgacggcgctggtagaccaccatattatccattattaaccagcatgcttggtcgcgacgattttcaaaacagattaggaggttccttcgaatcagaaaccttagattctttattgaaataattacatacgcccttatttttttgtatcaaccatgtaaccttaatgaatgtaatgaaaatattatactgctctgttaataaggaaggtgtaagacaagatctagcctcaattcaaaagtatctcgtttcagtggatgatgtatttgtgtaaacataaaaccagcccctgatacgtatcaaactttatatttggagctcaaagttatttttcgattctaaagcatgtgaattatgcgtctattgcttttcatttacataaaaaggcaattgaccgttcacgaaataaagcattcccccttagcaaaaagtcctttgggatatttttagtcgatatgtatcaatatacactcagccaagttaattcgtatttatcgagccgcatttaccattgcgattactaaacccttatttacagcaatccggggagtctgagttgcaatattagaggttttccagaatcaatatctgtgatcagaaaaattaaaataaattataataaaagctattggattatttaaggtttcttttattaacacgcagtattttattagatcaagctttttttccaaacaaacaattgaaagttttactgaagtcttcgaatacagaactttgggtaccaactgtcaatcaacttttcgttaaaggtaaattcaaaataccattttagctatgtcaagtcgtgttccggatctgcgcaacagtatgagctcttcgcagagtaaaaatagctctggtagcgcattagtatcggatgctgaagatgattcttttgtttcaagaagaacaccatcaaggagaccaagcagtattttttctttagataccacgccattggaacccccaaatgaaattgatatcaagaagttcactagcgatgatttccacttcagcatgataagaaatctacatctggctgatttcatcacaatgctcaacggtttcagtgggttttattcaatcgtaagttgtttaaggttcactttgactggcaaaccacactatgtccaaagagctcatttctttattgttctagggatgttcttcgattttttcgatgggcgtgttgcaagactaaggaacagatcatctttaatgggccaagagttggattctcttgctgatctaatttcttttggtgttgctccagcatcaattgccttcgctatcggattccaatcaacattggacgttttattcttgtcattctttgttctttgcggtctagccagattagcaagatttaatgtcaccgttgcacaggtaccaaaggacacctcgggtaaatccaaattttttgaaggtctaccaattccaactacacttttcctagttgctgtcatggcattttgtgtgcataaaggatatattacggaaaacattccatttggcatctacggagcatccgaatggtacgagttccatcccgctgttctggcgtttttcatacaaggttgcggcatgatatctaagagtttgaaaatcccaaaaccttaggtttcagaagacgaatttatccatcagcacctgttctatagatgtttagaatatctatgtctcaatctgtgtttgttcacacgattgtgcgtatgaaaattgttaaatagttatgattgttccatgcaagtgaacaaatatcaaagatcaattctacgaaagatattactgaacccaatttctgccaccatgattgatgtaatctattcgattttgcaacctaacgcaagaataagtctaactccataaaagctttccgaacaatcgagcagcgaaaacagttattacaaaatagtcagtctttcccacatatatattattaaggagctttttcaatagacaataatttatcctctacttatagtttgctaagcagctctttattcccctattgcacagacactggcagtatgattgattaacttcaaaacttcccttaattagggtttctaatgaaacctaacccaaacttaaagcaacgaattcagaattatataccccataaaatggacttacaataaaaatgagctgcggtccaatcaacttaccccaccaagtttattctcttttatccacagtttcatttttaatactggtcttgttctcgagcgcaatgagatttttgatgatattttatacgtggagcgctgtcattgccatgtcaatttattgattgaagtgcaacgcctttggacaaagaagagaataactttacaggacaaattaagggaatactagaagttggaatatatgagtataagatataaatacaaaacaggagagcaatcattttgaagtcatgatttgtatgggtaggtattgtgtcctggttggtaaaaatgcgacattgaagttgtctattttggtaaaaagtaaagtagctagcagtgagttttatccagtagaagcagtaattgcgttcaaacttgattttactagacctgcatattattcaaagaatggattgcaaaaaggattatcggtctggatgaacctgttgtaaatatgacatcttttgagcatagcgccacatatgacgaaaacgagacaaggaagcttgagcaacggctaggacatcacagcagcaaaataccacgtgttgcattagattgtaacgtgaacaataatttactggatgatgacccttttttcttttatattaatgacgctgacgaattgaactatttgaaaatgctaggagtgaacgtatcccccgagaaaattgaagaaatcttgatagaatttcgggcacaagtgctagcattagatactatcaataccttagaaaggcagcaaaattatctttctgctgaagaatcactttctgctctcctttataaagaagcacaacgaccaccactgaagactaatagttacaaacatttgttcaagaaaatccttatattctggcgtaaacaccaatatgcgatgaatacagacatatctctagtagattcatcggtaacttcttgttcatcttccatttttccacaaagagtacaaacgatacagcatgaaggatcgtttttcagtctcacgaatagtctcatatcaccaaataaaaggaaaaagacgtggtttatacaaggacatttgaaaaagcttttcaagctacaatgaacaaccaaaaaaaaactgtaactcaagtttaagcgtttgatatagtaatgtttttacttaaatatctctatcttataggttatcaagttcgaatgaatcgtcatcagtgttaggcacctttgtataaccagatttgttttttgctggtttgtccgcagtagagggtgcctcgtcaatggataacttaaaatcatcgccctggttttctatgtcatctgcccatgcaacggatttgtttgatgaaggtggcctattttccggatctattagaatagcatgtatttgctttctgaaacgttcacgcaagaaataatatgcaatggtaccggtaattgagaaaacgaccagaagtatgacagcgatttcgaatttatcagagttccggtgtctatccttgtgcgagttctcatcttcatcttgtttttgatcagctgacaattcctcttctcctgttgagtggtccgagtgtacaacgaagtcttttgagataataacatcatcttgattgtcttttccgactactaactctacatctttcaaatagatgtccataatacctctgctgattaaagcattatcgtaagggaccatatgcgatgcgttgtacacggaaacatacgtcaaattactttcgtgcttcacaaaacctgcagaaattgtgtcatctgtaaactggtcgtagtattgccagtcatagtattcggcatcattagtaaatccggtatgattgttccatttcatatttttaatcaaatcctgcacaccccttgagttgcaaatgatatccttatcaccattgaacaagaaaatttgcatgtgtttcaatagattgggtaacaaatgaatcgaaggctgggtgttcttgttcttcaaatgactgctcaccttactgtcacattctctccaatgtgggactttatcaacatccaaatgtaacgaatccatcacacctggcttacccaagaatttagaaacgctaggtaaatcatctggccagttgcttccacaagctgggtaggaatcgaataatctaaaatcatatatgttcgtacactcctgatttgaaggaactttattcccattttcatctgtctttctgcgggtgtaataaaggattttggtcaaaatatcttcacattcatcaaaggagaactttttacctccattattattgactaaattttgacaacgactatgcatatttaataaatcagggaagtaatcagccttcgttgaaattaagttattctccaaagcaaaaggaatgtaagataaggattgttgatcaggatcaatccaaccatttccaatcaacagactctttaaattgtacttcttaccacttcggctttcctcctcattgtcgtctttgtccaatttcgagttgaactttaggatttcattagcaaagaatggaatatactgaccagcatacgattctcctgccaaaacaaggtctttatccaaatcatcagggaaaatcttgaagtagttctttaaaaacttcatgaaatgctttgaaacttggttcaaatctttatcatatttcgaatcacctaccgtggaaaagccagtaccagcaggttgatccacaaacacaatatcacctctagtgtgccaagaacccggatttaaataggcttcgccgtcgtcatcgatccgtaacgcacctgattccataagagccccatctaaagatgagcatccaggcccaccatttaaccatataattaaagttttggatgcgacgacagacgtctgatttgcgaggtcatggaacttccaaaagaaatagtttttctcatcatcatcatcatcatcatcaccatcatctaagggaatatgacctgcatgcatttccgggataagttccttatctttaacgtcatttaacccaggcaacaaatcgggggccactaaatagtccttggcatttggaagacctcccaatgcacattgaatgagaagaaccgtttgaacaaagaaaagccaaagagacatgacagcactctaattatattctaatgattgttgtgattcatccatgaaaccttactgttaatatcagcaagagagaaatgataaaaaagagaataaaaaatatcgagcgagagtcacagcgcaaccttttataacacaaatacggccctataaatgtctaacaaactgaaataaacagcgaggtctgaaccaaataggcgtttttaacgttgattcaccccagcaaaaccatattcctaagtaatttcatttttaccaagcctttatttagctttaatatacacgaaactttcaaaactggcactggcagtatatccctccattgaaaaagaaaatctatgtaagcaaaaaacagtcacgtgatatatatatatcgcgtgactaataccaaaagcctgttaacatgaaaacctgtcaacgacaaaaggaaatacatgggtcacaatttccgtggtaagaagtcacataataggccctgagtcatggatcgaactctccaataccgcaactaccccatagttaccgcaactaaccgtactttaccgtagttgaaaaaagaaaacgaaacaccgacagggcaaaaagtcaaaccaggaaacccaatgcctaaaataacaaagacatttgcctcggaaataacagcatcactaaccgttacttaccgcgatgctgaccactgcatggcatattctcattgacaccttaattacagaaatcaacttaaaactagaaaccctgtgaagaatagtcacaagatctaaagatattacgatgtaaagatgtagccattccagtcgttatcgttaagtgacaacctttatctcgagcactttatttttttccctctattatcagtcttacgcagtatgctctctctaaaacttaaaagtctgtacctaattgcagtcaaatttctccaaagttactttttcagctggaattttttttttcaatttcagttgagaaatttaccagtatggtatatgctgtagtgaatcatacagtattcctcatgtatatgttaatatgtgtatatataagcagctgcgagatgaaaagatagaatagacattcgcgttatgaaggattagtttgtgcagtttacacagttagatttggtttatacactgtttgtaattcttatatactttagatatattatcttggcttagcatcaaaccaatctaaattgaaccaaaagctttcaccgagaatacatattacatcatgactcaaggtgttgctaaggatttttcacacttgtacagtgatgagactaaaagtcgtatgccttctcaattgaagtcaattatacattatttcaatgatccaaacttgatctttttgggtggtggtttaccaatgtctgattacttcccatgggataacttgactgtggaatctcctctaccacctttctccaacggtatcggtgccaaaccatctggggatgatgccgatacttgtcagattcatatcaccaagaacttagaggaatctcaaaagggtgtcgatattccattgtcaagatctttgcaatatggttactctcaaggtcaacctgaaatcacgaagttcttcaaagagcaccattctttgattcatgacatgaagtacgagaattgggatgtgttggctaccattggtaacaccggtgcctgggaatccgtcttaagaattttctgtaacagaggtgacactattcttgctgaacagttcgctttctcatcttctattagcgctgcggaggctcaaggtgtcaacgtgttccctattccattagatgaacacggtatcattccaagcaagctagagactatcttggataactggaccgagggtgccgctaagccaaaattattatacactgttccaactggtcaaaacccaactggttcatctttatccttcgataggaaagaagaaatctatcgtattgcccaaaagcacgatttcattatcattgaagatgaaccatactacttcttgcaaatggaaaaatacgaaaaagatccggcaaacagggttgtcaaatcctacgctgatcataaagagttcattcaaaacttggaaaaatctttcgtctctattgacaccgagggacgtgtattaagattggactctttgtccaaggtcctagctccaggtacaagattcggttggatcgttggtgccaaagacatcttggcccgtatcttaagtttacaagaaatgaccatccaagctcctgctggtttcactcaatcgatcatcgctggtaccatgaaccgctggggtcaagaaggatacttggactggttgatcggtttgagacacgaatacaccaagaagcgtgactgttgtattgatgcattgtacaaatacctaccacaagtcgattacatcaagattaatccaccaatcgctggtatgttctttactgtcaacattgacgcttccaagcatcccgaatttgcaaccaagtacgggtcagatcctgaaaaagttgaaaaggctatctttgacaggtccatcgcttcaggtgtattggtcgttcctggtaactggttcaagtctcaaggccaaaccactccacctcagccagaagcttctttcaaatccgaaaaacctaacgaaatattctttagaggtacttacgctgctgttccattggataagatgactgtcggtttgcacagatttggagatggtttgtacgaagagtttcaattaaccaaataaatactttagtcttagtacataatgccgaatcgttgctacgaatacatcctgataaattgattacccttgtaagtattcccatttcttcaacatcatgtaataaaagcacttactgaataacaaaccgccatgctcaccagtttatctttcctttgtaaacttgcacattttactatcaatgctcttatgatattggtttaacaaatagaaaatcgtgaaaattgtgaaaatatatctggtatcagaaagacattagatgttggataaatcaactgtatatataaaacgtagatgaaagatgtatgtatacaccgcaaactgtagtaaacgtagttcaaatgagtcgaactttatggaagattacggtttgcttgaatcgaattaaattaagataaatggaggaaaaagccaatacttgaaagagtttcatgtactgagcgatgagagactgaaatataacaaagtgttcaatcaaagaccaaattacctgggaaaaggcaactaattacttcattttcagggtatgagagattgtaacccactacatttgcaaaaggagaatatttcacagaaggggaggaatggaagtctctcaaggccagttttaacacccagcgccagcagtactttatactctttccttatgttgaatttcttgcttgaaatttagatccgaaactggtccagccgcgacaatttcttcgaatgatatgttattttgagattcttcatcgtcttgttctgtacccgtagtggataatctcaactcaccgcccttgttctctgggcccaaaacggttacgatcaacaagtaagcgaacacgcatcccatgaagatacacatcaccttaccataatcataagcgtcctctctaccttcaagtgggaatctttcaccaatggaggcttcgatagttgaggaggcactagatatcatattacccaattggtaagcaacaccagtgatcaaagctctgaactccgttggggctaattccgtcaaatgaattgggacaataccccaagcaccttggacgaagaattgtaagaagaagactgaagcattaattccagatttattagcaacaaaaccccatgggtataacatagcaccaccgccaatacaacatacaatgatagagaatctacgaccaaagaaagaggaggcatgggcaacaatgataccaccagcgatggcaccaaggtttgcaacagagtttgtaacagttgatgcatcagcggagaattggtattgagaagtcaacattgttgggaaaagatcttgagaaccatgggaggagaagttgaaacctgccattaaaagaaccaagtaaatcatacttagccaatattgagaacaggcaagcttagcattcttccagaattgagacttcccatcgttttctaatttttccaaacggactctttcgacatagtgttgggattcaggtaacatcaacctccaagcaatgaaaagcactgggggcccggcactgaaccagaatatagctctccaaccatgtggagaattatcaacaatagctctttggaacacgacacctaataaataaccgaaagcataaccttcttggaatataccagaaaggatggacttagccttgtttggagcattttccaaggcagtggcagaagcaacaccaaatacagatcccataatgataccaaagatagctctacaccccaagaaagcagagaaagaattaacgaaccctgtaccgatttgaataacgataatgagagccatagttaaaacaaatgagtattttctaccatatctgtcacccaaataaccaaagataagagcaccgatgacccttaatagcaacaccaaagtaatggcatgagaaatatcttttacaggtctgtctagatccttggccaaatttgtcatgttcaatgaaacggcaaagaaatctaacgcatcccaagtccatgctaagaacccaacgataaagtattgtgtttgcaaccagttcatcgaacgtaaggcagggaaaggatttatagggtattctttccttgcttctctaatcgatgcttttgttgggaacaaagtaggtattcttgtagccaaatatttcttagcatcactccatgtgatcctagattgcggtttcaaatatgtgattctaccttctgctttttcaagtgaagcgatggattcatcgcgagacactattgattctgcagccatggttatattttttttttgatgtcgaagtctgtgagtttcttcttgttatctagttctatatccatcaaaggtttaacccaacgtgaaagctcgaaacctgaaccgctgcgattaagatttaaatatcattgcccttatatataaacatattcaaatgagtctttccacgttcgatgtaagaatgacgcgaggataaaatgagatgaggcaatgcctacttgaattcctcttccccgctacttgacattaaacattccaatctacttctccaaattgaaaacactacaagttctacatatgctactagcgatcgctgcatccggttgtggaattatcaacctaataaccagcccaacaattactagttccatgttgaagcaaatactccatatggtttgttacaataaagcaaggtactatctaggtcaggcaagaaaaagaagaccataagttacggcccaaaggtaaaactagatcagtaagatcaattgaggaaacaagaagggaaataatacgagattaccaactgcatctggtcagcaaataccttcatcaggtaaaatatgcaatgtcagttttcccttgttccagttgagaacgaacggcattctaagaaagaaaaaaagaaaaaaagctaaacacaacgcaataagccatacatactcacaatcccgaagctatccgataagttcagattacttctgccaattgcatcattgatcagaaccctgttgctccatccctaatctctcctcagcttactcacactgatgagactgttcaaacgcttttttcagcgacgctaaaagattagaattgtttgaaaaagaaaaaccaaaaaagcagaaattatggaccggctaatagctatttgtcctacaaggccaggtaggaaacacaatagcttatcactcgatgagatgcggccgagaagaagatctagagcctagtctttgtcttttcttctccgatgttaagactcagaaaatattcacaaacctagacttagtcttcatatattgcagacatattgcaaacgcactctaccttgctttctgtggtgaactgaaattttgatcatgacgctttttcctgatttttattaaggttcgtaagagttttgattgagctcaatcaagatgtggtcggaaacatgggacatccgggtaacaaatgtggttctagtggttttattgtgacccgccccagtttacttttgggctccccgggtgttactccatagcaaccgccatctcgagagagcaccagtgcctcacaagaaattctgagatgagggtaacactaaccaatggcgggatgatacttgattgggtatgtcccgaacttagttgccgttacgagaagcagtatggaggtaactttgaaacgtttatcaaaatgaagtgttcttgcgattgttgcagttgaatcttccgtatagatgtatgtgcggacatgaatgtttattgtggggtacaaatggctaatagaaaggtaaactacaaccacaaaccacaggtaagcatatcatatatgcgactaggtctatgctatctctcgtgcggataacactgtttgctaattgagaatgtattgtataaaagtgattaatgaatttatatagtgataaagtcaagtattgtttagtagtgtattataagggtaaacctctggcggggatttgaggaggttctaaaaaataggaggaaaatcagttggtcaagggttcgacgttccatatttcgtcggcgtattcttgaatacaacggtcactggagaagaatccgacgttggcaacactcaaaatggatttcttcaaccattctttcttgttcttgtggtacacttcgtcaaccaaagattgggtttgcaagtatgatttaaaatcgtcgctcaccaaatagtagtcaccatgatgtctgatagattcaactaatggcttgaagtcaccatcaaaggtgccttgttcgatgacttggaacacttcctccaattcttgtggtaatggttcaccgtggtattggtgttgatatcttaactcttccacgttttctgccaagttaccaaacaagaagatgttatcttctccgatttctcttgtgatttcgacattggcaccgtcaacagtaccgatgattaaaccaccgttcataacgaatttcatattggatgtaccagaggcttcagtacctgcagtcgaaatatgttcacttaagtcactggctggaataataatttctgctttagaaacgttgtaatcagggatgaatacaactttaaagatgttattgatctctttgtcatggttaacaacatcactgacactgttgattaactttatgatcaacttggccatgtagtaacctggagcactcttaccaccaaagatggatacctttcttgggtacttcttctcaacttctgaaattgggacgccttgcgataacaactttttaatactcaaatatctgtagatacatccgaaaatgttcatttgttgacgtttgtattcatgaatacgtttcacttgaatatcaaacaaggtgtttctgatattatctctctggatgacatcttctccatcgtataatttttcgatcaaatctgcaagtctttgcttgttgaattgcttgacgtcgttccactgactttggaagtcttcgtcttcagcaaattttgccaactctgttagctttgacatgttcaacaaatagtcatcttgaggatcaccaatagccttactgatcaattcaccaagttttggattagcttgtttcaaccatcttcttggtgtgataccgttggtaacgttggtgaatttacctggcccataaatcttgacgaaatcttggaagatagtagtcttaatcaattctgagtgtaattcagcaacaccattaaccttatgagaaccaacaatggctaagaaagccattctgatttgtctttcctgagaggcttcctcgataatggaaactctactcaaaagatcaacgtcccttgggaacttgctttcgacgtgtttcaaaaagaaccaattgatatcgtagatgatttccaagtgtcttggtaacaaatgtccgaatagaccgataggccatttttccaacgcttcttgcatgactgtatggttagtgtatgcaaaggttttggtaacaatgtcccatgctttgtgccaatccaaatgttccaaatcgacaaggattctttgcaattcaacaattgccaatgtaggatgagtgtcgttcaattggattgcaacttgatttggaaaatcttcccaggagtgtttagccttcttaaatcttctaacaatgtcatgcaaagatgcggcacaccagaaatattgctgtttcaatctcaattccttaccctcttggaagttatcgttagggtacaaaacagcagtgatggattcagcacgttgctgttgttcaacagaattcttgtaatcaccactgttaaacttggcaaaatcgaattcagtggttggtctagcagtccacattctcaagttgttaacattttcggtcttgaacccaggaattggcatgtcatatggaacagcaatgactctttcacctccaatccatttacttgcacacaatgtagagccatccccattgttatctgacctatcaacgtaaccgtagaagttaattggcacttgaatttcacttctctcaatttcccatggattggcaaagtttaaccaataatctggggtttccacttggtaaccatcgataatcttttgagcaaagataccgtactggtaacgcaaaccataaccccatgccgggtagtctcctgttgccattgagtcaatgaagcatgcagcaagacgacctagaccaccattaccaagagcagcatccggttcttgctccaacaaatcttctagcttgaaacccaactcatcaatggcgcccttaattttttctcttttctcaacaccactttcctcagaaccatcttgtgagttaatcaaagcgttatccaaggctctacccattaaaaattccaacgacaagtagtaaaccctcttcgagccacgcgctgtttgtctctgctgacttttgttccagtcaatgaccaagttgtcacggacactttgagaagtggcttgatatgcagctaaatcatcacaattgtacaaagaacgagccaatgtcgtttcaacgtgttgaatgaatttggactgaaattcgtctggggtttcaaacttcttaaccccatgttttttccaaatttctctactctgcaaaggaatcatagtattaatactcttaatttcctgaggcaaaaacccagtcaaacgacgggaaagacgaggcacaccatgaggctcgtcaaccatcatgtcattggatgtggaagtgctcaagctaggtcttctagcagtaccggaacccatcttggcttatcttttcttattcttagtctaaaaaaccgcttgcaaggcccttaaaaatatatatagcttcctttcaagttaaaatagtcaatcaattaactgctattatatttgataggttggccttgaacaattgtaacaattgtatctgaaactttcacaattcttcattcaaggtggttaaggctcccctttctttcatttcctttaagacatcccttttcaatggttcaattggcatttaaatgcaaagcggaaaaacaaaaaaaactgaaaagaaactattttggtggatggcctgactatggatgtacgagtatttctctagatataactaactatttacctataactacatttaattcgttttcgaatacagacaaagacgcaacccttaatctatcagagaccgattgttgaatccatgtgcgacaagtgatatcaagtaatatagtttatccctgttgtcaagttatgaggtccaattactatgttacttgatctatgttccatcgtttaaaagttagaacgaaaatcctctatgcacatgttaatctccgtactaaaccttttattccggcctcttaatgcaatatgttctctattgtttccccacgctttcagaaaatgtagttttgtacgttaattacaaagcttaaggggcgacgggataattgcttatggttacaacgtgacgaagagtgacattcctcgtcaaaaggtgaactggtttctcttatacaattagcgtagtttgcaacgtgatcggcgttctcttgagaattcaagcaaggcacagatgtgaaagtgaatgtgaaagtagagatgtaaatgtgaattaagtgaaatatctatttatggttacaaatttcaaagatagtgcaaatggtcaatttagttgaattagtctagttagtaagttttcattgaggtgggttaggggtgatttcatctagaacactacagttcggatgtatcacatacactgtcttggcatttgaggattcgacatcggcagatagatcgtcgttttgaccatgtatttgcatcaagaccctgtcctttaccaatcttttgatgactttgaatgccaatttcctttcttgccaatattctgcttcggtgttgatgtcgttttctttctgttgtaaataccaatctactatctcagtttttgtcatttcaggttcttcattcttttctctgtcaaccactttccgtacaattagattcatcatttccacgtatttatcatatgatattgcgactttatgtgttgtgtgatgagcgttgtcatgagactctacgtcaggaccaccccccgtttcggagtcggcgttcagtggttgagaaggtgactgagattgtgtatcaagtgtttcgccgaagtgttgtgtggcaggtattgtgccctcaccctccgtactttcttctggggagttatcgtcatcttcaatttcaacgtcatcaacatcaacacggatgatactctgtctcaacaaatcgtacgcctcagcgacaaagctcggaacaatttcatccacgcaattagcacgagcaatagcttcacttaatctgattaatgattccagttgtctgacagttatacggtacgaagatttactgtacccctgcgcatcgtctttccttagttctgtatatcttttgactaggtagtcacgagcttctttagtcattaccggcttgaaagtcttggcatagttgatataacgactcaattgttctgctgagaatggtggattaatagcagagtccctcttcatgtgcaagtctacgatgtgggaagctagctcagtatcgatcttctcattgcaatcatcaagaatgacaaagaataaatcgaatctggacataattggtgcagacatgttcaaattagatcttaaagtcagtttcctattgtacctaccgccgacgggattagcggcagccaaaattgaagttctggcatttaatgttgcatgaataccagctttggcaatcgaaatggtttgctgttccatggcttcatgaatagcaacttgatctgcgatatccatcttgtcaaattcgtcgatacaacaaacaccattatctgccaacattaacgcaccagcttcaatagtgaaatcaccaccttcttcatctttcaccacagctgcagtcaaaccagccgctgaagatgctttaccggaagtataaacggctcttggagagaagttacagacgtattttaggaattgagattttgaggtggacggatcaccaacgatacaaatattaatgtcacctctcaatttaatgccttctacagtagttttatgaacaccgctaagcatttgtaaaaggatacctttcttaatggtttcatgcccgaaaactgctggtgcaatcgatttcaccagtttgtcataaatattctcatctttcaccatctcttttaattcattaatttcgtcagaatcaagccttgttaggaaaatttcttgatcagtttctgccgccatttcatagttttgatagtttctcaagttaatataatcaaatttggatgtcttatcggcgtcctcctcattaatcctactaccattgaaactggtaccaacattttcaacatggcatgccaaaaacgatattttgtaagttaaatctctaacacctaatgatttgagcccagaaatacctgagttcaatccttccgttgtccgtgagatacctctagaatctggagtcgaacttgctttaacaccaggcaaaccaagttgactaacgtctggaacgacaatttcagtaccaataaatttacatctatcacctggtttagctctttcgacacagtcaccacgaagaataatatctaaggttcttggcatagaaccggatggaatttcattggaattttcttgaattcttaccttttgccaatccaagaatttggacctgttcacgtttaatgaccagaaagattggttctcacatgttggatttggacaagaggttggttcagtgtacttgaaaacttgttccacattgtcaataacagctcgacacaattcgcatgtaaaactggctttgtataattctggtctaatttccgaagttctcgtgactgtgcctgaaatagccattaaagaaccaatcttattagccctaatatctctgattctatggacagttgggagattcaggaaactgatttgcaaaacacgttcaacctgatctggattagtggcaatggtagatggggcagtgcctcctgcggtggcagcctgcgaagttggcaaagatgaatctattctttgcgaagagcggtcctgagaattctcttgagattgagaaggaagtacagagtcagatgttaataataatccaggagcgtacttcttcaccacatttcttagcccagataaaaggaatggcaaaaatctgtaatactgttgtaaaatagcaaccgctaaagctccgtcttccacctcggccaaatgtttatagtcaacgtatatggtattcaattcgtaccatctcatatattcaatttggactctataaaccttctccatctcacctgtttcatcattgagggcggtgaaatttgacaagaaatgttcgaatgcctctcttacagtttcaccagttttatcatcaacctttttgatggcattcaagtttttctgcctgatcccggctaatggagtaatttcttgtgaatcattttccatagcctctatttgtgattctgaattaatgccttgcctagtgtcatcagtaccgaaatgtctatttccatctgacactcctctggaagaagatggaaactggggagttctgtttcctaacgactgatcatcgaattgtgaactatcataagcacctacactagagggaggctgggatgattgctgaccatgttgaaaaggacttgatggtgccgacattgttgctgattttttcagcttgctccaactatgtccggttttggatgagccgttcaacctggatgcccttcacattgaagatcatgttttaagtgtttcaacatgtaaaatcatttttttaatttctgagttaaggcgattcaatattacttttcctaaagaggtattgcaagtatccaaaattagttaactgaggtataacacgaggaaaaccattgactatcgaccataacatatcgataaccaatgcagcaaagttcaatttaatggaattttttctttttgattcgatagggagaagataaaacatcggtgaattgataataaaaattaatgatacgtaggtaagaattcatcttatttaagcgatataagtatatggacgcgaggattttagaaagctggccagggataaaatagcccccctgacagtcagttgcattaatggtgaagtgaaaatgaatctaaaatcgaaagaaaagaaaaaaatgtaaccagataaaataaaccgaaaatgttaatgtggacataggtccactgaaaagccgaatggaaaaagattcaatcattcttggtaattgtaagtataattgaaaaagttcatgaattgctgagtttctctgaagtgcctctcacccagagcgtactcattcatttgtctttgtaaagtagtattaatcttaggttcattcgagttattcgtgaatttcacttcttcttccatagacatgcctgcttgctcgatgtcgagggggagtacttcccaatcaggatttatttgtgacttttgatcggtagatatgaagttcatttctttatggagaacagtatgttcatgggaggattgggatgagatagaccgtacggtgtccaaagctgcatcttcaactggtgatttgttcaatgaggagaattcatcgaatggttgtgtacatttgcgtaaatgagtagctgtattttgagatcccgaatgaggtattagttgtggttgtcctgtgaaggggacagagttcgagggagcgagagatgggacaccgttgccatacacttggttttcgaaatgaccgtaattctgattgtcgttatgttcattgatatttccattgatatttccattgtagtttagtggtattgaagccagagcaaaagtgttatccaaagccaggtcagatatggtttgtttgatgggcggggaggcagaagccggtttagaatactcactcgataacttcttcctattttctggcatgaagttgctgataggcaccttggcttcgctgatagttgcttggttggaaatgaaacgtgactgtccatcagaggtcatgatcattttcaacttcccacactttttactcttcttcaggttacccttgaaagttggcaaaatagcttcacattcacgattttcaatatgatgttcaatccattcatttgtcgaatcaaagtgttttttacaacggccgcaatgtccatgagagttcacacggtccacattcttaacattatcaggataaatgaaatgccttgatctcaaatgggtcttataagaatctcttctggagaagccacctgtcgagtgacaacgtttctcagaaggtagagatgcatcccagaagggacaatgatatgccttttctatggcatgtttcttgatgtggcgagttaaataccctctcattttgaattctgcatcacaataatgacacacaaatttcatatctgtttccttcttctcatctgacttatcagtgggcacctgagactcactgtcggttgatgagacaggaacaataccactagaaacttctggtgttgaacctacagaactatcttctgacttgataacatccacatgatcattcaatgatgtcttcgaatcatcattcgcagacgtctctcctgtctctggagtagcgtcagtcttaggggtaatatcctgagtagttttcgtttcacgatcctcatttacctttggagatgtattctgtgcgaaagctctcttagaggtaacagggtcagtgtctatcgtcatcttccattccatttgaccttcgggagtccttgcaacggacattgggctttgtaatccattgatgttcaaagaacatggtatgacagaggcattatattctaactgtctgtccacattatgcgaggatgggaaaagagaaatgcgcctgttgtcagtatcttcttgcgagttctttccattttcattaagtttcccatcttcaccttcatcttcatcttccgtttcaaaatccgacttattgcccttgtttctcacgtccatacttgaatcatcctgtaatgtcttacagtccaaagaaacacctacgacgtgactggcgatggcattgaaccaattagtcaaacgccaagagagtcgtttgagaattgacttatccgtatctagcaattgcacggaaggcatggctgattaatcaaatgcaaagtcaaataaacgctttcaataacaataagatggtataagctcaagttggaaatttcaaaatcaaaagtgttgaactcttagacttcagtttccttgagctttattgttttaacaatctgagtcaactattgtcaccttcgtttgtgataaatgatcaatggtattaagaccaaacaaaaaaaaaaaacaaaagaaaatccttcgggttggttacacttctcagataacagtcaaagtaagtaatttatggatatatgcaatattcctagttgatgttataaaaagaataattagaaagcaccactaatcgcaactaacttgcactcaaaaggccaaaatctccaattattgattttcaatcttcaactttcattatcaattttccttatccatcattctattttttccctctgattgccatggtcgcagcttttttttttcattttcatgagatttctctttcgaaaaactgaaatttctgtcagtattaatccagacatgctgctaaacgggccggagaaaatacggagatacttatcttgaatacgtagttagttgtgttcttcgtgttaagtgatgtgctcatgttgatcgggtaatatattaatcatttgcactctataagagtaatgaaataactgtctgctcagggaatcctagtttacagtctttcggatgcaacgcacgtgatctcattcatatatggcagtttaagcatttgattctaaagtccgaagctggcattagaatacatctaaaacgtgtaaattgagtagtgtacatgtttaatatagtttacatttcgagtaaagctgtctgaagcttataggaagctgaattctgactttgtgaattcgggatttgatatggttattattcaaatgcatatgcaatggagtgtttagtttatacttcatgcaggagagaaaaaaaagagtgtgagatgaaatcgataaaggatagaatgcaaatatggtgaatgatgcagattcacttatttggaattacccattacggtgtcgtcacttttgtttttagtgggttcggtaatggtacctgatgttagctctggtaggttagattcgattgattttctggaattcaaggaccctaattcccatacagtcgccgagtctccactgatgttgtcttgtaaatttgaccaaatatcaccatcatgcgtagatgtacatgggggttcatcggtttctactagttggtagtcctgttgtacttcttgtagtctttttctttgcatgtatctgtagtagttgtaatagcatacgtcgattagtacaacaatcatgcctaaccagttgtaaaatcctagcctttcattgaataccagcatgcctaagaaaacggtgaatagttctttgatgatcccggtgacacttaaagttaatacaggagccaattgtaatataccaaactcacacattgttaatatgaaaacaaggcagctagggagtgtgagaagcgctaatccacgtaatagagccgcgagtttcgaatgaccttcccaagtcatcaattcagaatgcagtacatcaggaatcggacgttccactatgaatgaagtggaaaatagaagtatagtcattggtaaagctaattgatatagagtgatgaccgggtttttcttagtagcaggtttgtcagcagccatcaactcatcaccatcgttgggtgacaagacaatggtgttcttcttgtggttgagaataacttgaacgtagacccatctgaaccctcctagggcacaacttatcaccacaagtatcacaccaaaggtttcctgaatttcaccatgagtctgagagctatctgagtttattggttttaaacccatcatcacaacaccacaaaacatcaatgtcactataatgaatagtctccaagatggtacttccaccttgaatagacagccaaagaaaagaacgaatgcaatagtagatgatttgacaattgtataaacagtgaatggaacgtatttgaaggaaatgttgcctaaaccaatgtcaccagcagttgctatagcagttgggataatgtactttgcatagtacttccaatcacctttgttcaagttttcgggggttagttgacctttccaccggagatacagatatgccataccccataactgtgtttggtgcaagcctgtcaccaacaatgggtatggaatatgcaaacttctattaggatcgaacatccatttgttgtacatggtaagaagaatggctgcaatatacatccccatgatcaaagtgaagatcctcactgtgtctctatccatcttcattgtttttagctattttatattgacaaaagtactacgccaggcttcttctaattttgtattaatatctcgtctccctacagtagcaatgattcacacagatctcccagaacttccattaaacaaatcaattgacttcgaggttctatgttatttcattctctacatgtggtaggcacaaacctagttacgcatctttttcatgttgaacgaaacctattttcttcttagatgctttcctatggatgaggctggtgaaaaaaaaaaaaaaaaaaattaatgaaccactaacaaatgagactaggaccctattgagataacttacagggtttttatgaaccggaagccggaacgttatatatcaaagtaatcgtcgtaccaatttggctcccaaaataatgttgtttttgacatcttgtgccaccttgtcagagaatatcagaaggattttcccaaaagatacagaacaatcaccagctgaatataccttcaaattagtatgtaccagctgtagagaggagcacgattcccctattagaatcaataggtttgaatctcatgacatgcctggaagtaaaggaaatgcctcgttcgtgatgaaatgtaaattttgtggcaatgagtgttcaataaacttgaccaggactaaggaagacttatataatttagatgaagaatctaatttcgaattgattgaacagggtaaaaaggacagaaagaaggttggcttacgttctgttcctgtggaaaaagctgtttggctcgagcttgactgcagaggatgtgaagtaactaaatttgaacctgctgacactatttttgtagctgaactagtttcgaagaaggaaatggagtttcagtttgaagacgacgaaaacgaatggtatgattatgatgacgatgctggagaagaagtgagcgtagtagatatgaactttgaaattgtaaaaggcaaataagtagacttttgtttagtttacttttgtactttatttctttaacattatttacttgtaaagtatacatgatatattcatttcaaagtcccaccaacttataacatcatcatttattaacaatgataaagttagagtagtggtaatttattggatcattcctctaagttgacgtaattacttgggaatagacccttttcacctgatgattcaagttcacccaaccaccaatcatcatcgacaaattgaatattaatgattctttcattttcttcaaaagtcaattcattatcttcgccggcttcgtaatcatattcagcaatagctgatggtccggattctttctttccaggtttggatgctcttggtgctggagatggaggagtattttgagacttagaaaatgctctttcatcatcatcttcttcgtcctcgtcactttccggtgggggtggaacatttctcctagttggtagagaaggagcttcttcctcttcctcttcctcttcctcttcctcttcctcttgctcctcctcttcctcctcatcgctttcgggtgggggaggaacatttcttctcacaggcaacgaaggagctggagtttcttcctcttcttcttgttcctcctcatcactactccagtcatcgttttgttccttcttttgatcatgcagacctggtagtggttggccaaacttgttctgtttcttggtccagctgtcagatgagttgatcttagaagcttgaggtctagatctgctagagtcacttggttttatgataggaatttccttagttttaattgattcaaattttgatctgacctcttcaatctcttcttcagcttcttcttcttcgttagaatctgagaactcttctctttgggtcttgttctctaaattagatggtttcttttgtcccttcttttcagcccaaagttgagctggtgacttttcattcttgaaacccttgatcaccttatcgtcgctatcgtttcctgatgattgagctgaggaagaactctttggtcccaagactttgttgtattctgcatccctctttagcttggattcttgctttaatttagcaatctcagattgaggatcaatctttttgtcgtaattaggccccgaaacaactagacggggatcttctttactgttttcttcagcaatcactttttgtagatcaactttaccaattggtttccaggaagaagaatttggttctagtggtttcttgtcgaaatcacgttcttccaactctggttcaccccattcatcgtccttcttacctctgctcttctcagtctttgggggagaaacggatcttcttgatgggaacgatggtgtaggttccttttgctcagattgtctggatgaaacactgactggtttcttggctgtcttggcagcagaggaaattggcttcttggaggccggtgtttgttgttgaattgaataacgggcaccagcggagttgctgattttcattaacaattcagattcatctaagtcatcctcatctctggcggtaacctgaacatggtaggtcttaaacacttgattagagatcacaccgaaattctgagcaaatgaagctctggttttcaatggagcggaatctggacaccaaccaattaaaatcaacttctgaacatcagaacctggtggagaaacacgagctaaaccgtattgaaccttggtatcatcgaaactttgcaaaaactcgctgaaagaagtaccgactagttcaggttcgtattgtttcttagaatttggcgagatgatcaaccaagtagtatctggatcacccttcacaaccttcaggtactcggcctcaatggcacgcgagtgtgtagtagtgtcaattggttcaaatgccatcgtaattgctatgccagactgataaccctataataacttaagatcaataacaacaagaaaggaacgtaatgcacctcaaatttgtctggtaaattggcaaaaacacacactaattcaattgactttgcagaattcttgtcttaagatatttctatatttgtttaaatatatataaaggtaggatggtacaatcattccaccaaacagcagtggattgattcatgtttaataatttaacctagttcaaatattgcattcatggcgaataggagacaattgtcaagattttatttcataggttacccggaatatgaactgtggttttagtttcgagaaattcgtgcagatttcatttagagaaacagcggttgacatgaaaccgggtaatatttagtaccatgaacagcggtcagagtagagaacgatattgcaaaactgttattagctttatgaagagttttcttatcaaggaatcaataactattttttggaataaagctgtgatgatgtttctgttggaacaggaaattaactgtcggtgagaatttcaaattgctcgatgttctattaattattctccggccagatttcagcttattttccactacgaaacggaccttatgctgaaatcactgttgagttaaacattggttataatgatgggggccttaccacaataactgatcccggaacgactttccacgttcatgattctcatatatgcatgttaggaaactatgccatcgcaactctgagaaaggtactggtagacaagctccgaaatcgataatatcgataccggcaggtttgtattcactgacgcactatttgaaaaataggccttcttcgagattatacaagaaattatcgaacccaaggacaagattcagatcgagtaaatatcatatatggtcaaaatacgatttaatacaagccttcatcgatttatgggcgtatatgtaatggcaacaaatttatttctaccggtgatggttccttttcccccgcggctgatgacgatggtggggttacagacgaacttggttattcgaaaccatctactactttttctccactgcaaaaagaacttgtatccgattttgaagctgttaaattggcttttccccgttcctttggcctttatgacgcaagatgtaaataaaaatgtccgaaacttgtcacttagcagttatcaccgaagttgcatattgagtggagcattagaatcctatttcggcaagaaaatatcacagaaaatgggggggaggacggattaaggcttttcaaacaaactatacaacgaagctatgtataaggacaatcaattgtcgctaactgacggtcagttgcccatttgagtgtcgtttcataagaaaatacatgtgtggaatttgtatcacgtgactatgtctatgcgataccttcctaaattgtgggtgttagccaaaacatttgcaagcattcgtaactaatttagaatcttaaccgtgttcaaagagctttcaacattcaaattattgggacttttcatggaattacacatatttccttacattgttaatgtgctccccataaataagtttaaattcatacacgctgtggacttttctttttctgctgatgttaaaaagtgaaaagaatcttcggtgatgagatgagatgagatgagataatatagaatgattatacagataaatgacttatattctagcatcggaatatcctagttgaacgcataccgtacccaaacataaactgctcaaagaagatggtaacatttaattgtgaagtgtgtaacgatactgttcctaaaaagaacaccgaaaagcattactaccgttgcccacaagcttattatacttgtattgattgtaaccagacatttgatgacggtatctcttacaagaaacacatccagtgcataacagaggatgaaaaatatcagaaaggattatacaagggtaaaaagaacggtaatcagaatgaccaaaatggaaaacaaccgaacgctcaagtgaagaaggaagtcaaggtcgaaaagaaagaggaaaagcctgtcaagaaggaatctaaaccagagaagaaggataagaaggataagaaagacaagaagtcaagcctaatcaagggtgaatcattgtataaaatcttaaaatctatcaacaataaagacgacaaaaaagaattattgaagaggttgatcgtaacagcggaaaacaaaattgagctgcagtaactaaacgaacattcttcgcacattatttgtttacattattttacagatgatttcgtgaagaaatctatactagcgattttaaaagtacataattcattaaagagcgtgaaactatcataatcatcacacgctcttagacaaacctttagataatttattataaaactgattcaacgattttagcggaaaactgagggtctcgaacatatactcggggagctgatcttgtaactgtttcaattcttgtactgacctttgtttcaacaacggtacgtaaacaatctccgtctcatcgtccttccccttcacgaatcctaacttgtaatccattatcccattcttgttcccttgactggtatcaaaccacagccctagatcatcctcatatgtcttatgtatccttactccacacaattgctcgaataaatctttcattatctcagattgttcctctgcgtccgctttcgaatcctccaattgagaaatctttgtcttatcggattgcaattgttccttcaaagattctatctcctgttgtttcaactctaattgtctcatcagcttcacattctcgtttaacaccccttgtacggccaagtcagccttttcgaggcgatcctggaccgattccttatattctgctagagggtccataagtaaacaaaaaacacagattccgagggtggtaattaactatgttgtcagaagattttgattagatatggtccagttaagttattcccaattgctgctcgtcaaatactgccgggacaatggttttatctatataaaccatggtctcaatcctatatgataacaatatatacacatatatcttactatgagcataaaagcccaatgattgagatttacctcccaaaatatcaattccgaccccaacctccttacaccacaaatggcatcccccaataaaagtagcagttcccaggaagtcacgtgagagaaaagatgaatcttctttgaacaatttacggcgagaaaaggacaattagcatgatggttgaaataaagaaaaaaaacaaaaatgaaaagtctttaaatttaaacaatacctaatgtgtgtttgctgcaattgcacacacaatttcaatcatttactgctaccaccacagtgcttaaatctactgagcgacagcaacggtaacttcaacgttctaggctaactgtttcaattttggtttgaattacaaatttcaagtgctctctattgttttgaagcttggaatctgaaaacaatagagactataattcttatcgttttcaccaattatctcggcagaaagttttctttgagattagaaatttaattggacgattatacgttaatatctttgaacactggttggtgtcttactttcgtttgaattacgttgttacactttgataaacacacggggagtgactgagaataaagttagtattatttcataaatcaagatgagcagtgttgcagcatcgcaaaataaaatcaacgatttactggaagcaatcaggcaagagtttgccaatgtttcgcaagaagcaaactcttaccgtttgcaaaaccaaaaggattatgattttaagattaatcaacaattagcagaaatgcaacaggttagaaataccgtttatgagttggaattgactcacagaaaaatgaaagatgcgtatgaggaggagattagcagattgaagttggaattagaacaaaaagatcgccaattggcctctattgcccatggaagtaccgttggtaatgttccaggtcaagttcctcagcttagtagaaattctggtgctcagggaaatgctaacattgcgccaccaaatattccgcaaccaatggtttcgcaaactgtaggtactggtatggccccacaaatggctcctttgaacactcaacatcctactcagcaaactaagtctaatgctggagagcaagcggccgctaatttggctcctgtcattcagcagcagcaacaacctcagcaacaattaccaccacaacagcagcagcaacagcagcagcagcaacagtctaacatcccagttaccacggcagctccagttcaacctgctggtggtaacttagaccaaaccgtaccaaatagtatttctcctcaacaacagccaacagagcaacagcaacctgcaagtacagccactactgcaccagccactgcttctacagccccaccaacatctgctccatccgatcaggtaggtcaagatcactacttagttcctgccgaccaacgtgctgttcatgccaaaccaatccctccattcttgttagacttggactcacaactggttccttcacatttaaagaagcaaaacaatgactactatgttcttcacaatcctgctctacctacggatttggatgttgaactacataaatcattagaacattcttcggtggtatgttgcgtcagattcagttccgatggtgaattcttagccacgggttgcaataaaactacccaagtttacaaagtttccactggtgaactagttgccagactatctgatgattcagcatctcaaccacaacctcaacctcaaaatcaaacagtcactgccgaaacctccacttctaattctaatggatctagcgctgaagatggtactggaaaccaaaactcagcagcctctacagcatcctctgatctctacattcgttcagtctgtttctcccctgatggtaaatttttggccacaggtgcagaagacaagttgatcaggatttgggatttggaaactaagaaaattgttatgactttgaagggacatgaacaagacatttactctttggactacttcccatccggtaacaagttggtgtctggttctggtgatcgtacggtaagaatttgggatttaaccaccggtacttgttccctaacactatcgattgaggatggtgttactaccgttgcggtttctcctggtgaaggtaaatttattgcagctggatctttggaccgtaccgttagagtttgggattccgatactggtttcctagtagaaagactagactctgaaaatgaactagggacaggacacagagattctgtttactctgttgtctttactagggatggtaagggagttgtctccggttctttggatagatctgtcaagctatggaatttgaacggtctaagtggtcaaaagagtcatgcagaatgtgaagtcacctacactgggcataaagactttgttctttccgttgccactacacaaaatgatgaatatatactttctggttcgaaggaccgcggtgtcctgttctgggataccaaatccggtaatcctctactaatgttacagggtcataggaactctgtaatctccgtcactgttgcaaatggtcatccacttggccctgaatatggtgtatttgctactggtagcggtgattgtaaggcaagaatttggaaatattctaaaaagaacagccaacaaaactctacccaaatcaaagagattaaagaataattcctgtaaaggctacgactaatggccgtatttcagtataccttcgatggtattaattactctggttccaaatgcaatgcaaagaattcaaacaaaagttcgatatcaattcaagaggtaccaaattatacaaacaattaactctatcaaataatagaagctgatgtttttccattttcatttcacctttctgatttcgcagtctctgtaacactatgattgttttctcgtaagttttcaattattttatatcttttttaccgtcttgattgataatttataacatgaaaccttattttactcaagcagatcgcatcctgcagttgtttatgttcccacgccatcgttgacatttctgcttttgacaacatctttcggtaacaacagctttttttcattctatataatacaaattgcggcagtagaagtgtggatacgagatgaataaaatgctatgacgagatacgcaaatgtatggaacgtgttaccattgatggtaattaaaagtactgtgtgattatataagatattattaagttatgctaaaacagatttggtattaattagtgcgagacgatggcagcaaagcaagttaattgaagtagtagctatttcacaaaaaaaaaagcaggtattccactaaatttattggtgggcttagttacttggcaaaccggtcgcagaatcgattaaggataagtccgtgtcttgtggacctgggccaactctggttaaaattactctagttacaccttgatgtagttcagagtccaagtagaaagagacatcatccttaatttcatcgaatttagcattgaattgtgatagttgttctttggtgaacttagattcccagcctgagacgttttggaacagatggtacaggaatgcaaatagtttgtcttcactttgttccaaatagtacaagactgcatttggaccagcatcaaaagtataggccaccacagtctcattgtaaaattcattgatagcatggcaaagtttaatgactttcttggatgtatcgttcaagtagaagataggagggtaagaatcgagacaagtggcatggaacgagttggaatctttcattgtcaactccgcgaaagttgggaaatccttttctagtatagatttcttcatttgttcgaatctcttaggaaccacgttgttgattctttcctggaataggtctgatgttttgacagtcaattgcataccgctggtagaaggagtatccttcttgtcagcactaacaactaaaatagcagccttcatttctggccagtgattcaaagagccaatttcaacagctttactatcactaccatcttccaatttacccatttcccaggcaacgtaaccaccaaacaaagatctgcaagcagaaccagatccctttctagcaatcttagaaagttctgattcggattgagggagctcgtacagcttggcaatagccttaattaacgcagcaaatccagcggctgaagatgccaaaccagcggctgttgggaaattgttttcacttgcgatgtgcaatttccattgagagaaagttggcaatgatgaatctttttcttccaattcacgtctcaattggcgcaaatcttgcaaacagtgctgggttctttcgctcgctagagactcttccttaccgttcaaccacaattgatcttttgcaaaatctggtgaagtggtagccgttgtcaaagtacgtaggtcttcttgggacaaagtaacggaaatagatgagtttgttggtagattcaataccttatctctcttaccccagtattttaaagtagcaatgttgactggagcagttgtagaagcgctgtaaatagacatttttttgttgttgttagagatgatgtacagctaaattcaatgacccaatgcaagaagttttctgtttactccccctattcacgataaaaaaaaataggcttgaaaatgctaacggtgatcaaatataaactatccaaaatttggatttgaataattatataaagtttttttagaaacaccaagggatctgccttattccttggtgaatatcaagaaagtctttgggcgttacaatatatatcaactttttcaactttttgtcctgcttttccatgcgaaaaatatgaaacgagaagtttcgtataacgaagtcacgtgccaaccatcctcgtgtaatccttcgaggcacgttttggcagtgatgtatgcctccaaataaatatgaatattattagctatgcaaaccacctgaacatgcctcgattcgtgtatcatttgtagcctgaagattgaaagtatttcttcgattatgtggtcacctgactctcatttcctaactgggcactatatcccaaagtagtaatctggtgcctaattagggaattcctttcaatcaggttcaccacgattagcaaaattccaaggcttcacatggaattttaggtttgactatgcaagaagataggttcatcattgatggaaaaaaaaaaaaaaagaacaggctcctggttatggattttgattgtccgttcatataacttacatagtatctttgtttagggttgagataagatgttgtatctaaatggattagtgagaaatgggatcaatatcggtgtaaaaagaggtacagctgttgctttgctagcagctaaataccgttctccaatatttgctgcaactagataccaaagtaataaggtagaagataaactggctggtgtgtttactgaggagcaattgaaagaagcccgagaaactagattgaaaggtttgggtccttatgtttccaaattaccaacaaaattgattccttatgcggaactaatgagacttgagaaacccgttggaacttggttgctgtacataccatgtacatgggcaatcaccatggctgctatggaaacagctgctccattgggaagtactttgtggatgttagcgctttttggtgtcggtgcactcatcatgagaggtgcaggttgcacaatcaatgatttactagatagaaacttggataacaaggttattagatcagttgaaagaccgattgctagtggaagggtatcaccaggtaaggctgttgtatttttgggagcccagacagccatcggtatgggaatccttgcacaattgccagctgattgttggtatttaggtttggcatcgttaccaattgtcttcacatacccattgttcaaacggttcacatattatccacaagctgccctatctgcatgtttcaattggggctctttgttaggtttccctgccatgggtctgatggattggtccactatgattcctttgtacgtcagtacttatatatggtgcatgatttacgatacgatttatgctcatcaggacaaaaagtttgacatcaaagctggtatcaaatcgactgctttagcttggggtaaaaacacaaagaaaatatgtactgctcttggaacggtacaaatcggaaccttagcacttgctggattgaacagtggtttgttgctgggccctggattcctctgtgggctgggaattttcacatacaggttgtttgatatgattagaagggtcgatctaaatgacccagcagattgttggaaatggttccaaagcaatattaacaccgggataattttttctggtgctttgttcttcgattatattctgaagttattaggctggatgtaagaaggataaaaacatctttatttatacatcagttcctatttacaagtaatcttttatacatgtacatatgggcatttgtcacatttgttaatttataccatttaacaaatttccattattgtattcttaacaagcctgaaatgaatgaacttctaatttctcatttctttccatcttggtgatgcttgctcttggaatttaacacaatattcttaatatcagcgttagtattcaatcttggccttgctatttgttgttgaattattttctctaacttctgctcgttcttggtgtattcgttcttttcggtcttgaaatctttcaactccaactgagttatagattcacctccaaataatgcatccataaatcttccgtcagatccccagaatttacctgatctgttcacaatatagactttatcgaaaaaaggcgcccctttatccatcaaggagaaagaaaatgaaccacggtcctcaactccttgttcacctattcctgtaaatactctggatttttcgtgacgtcttaagtttcgtaatggaattgttttactcttttcaccattgaataaagtcctagtcgtcactttacattttgggatcttatcagggatgtaatgcatcttggttacaattctggtcggtatgtatagtgccactgcagctaaagtgaaaggtatcactgaaagaaggacagaacccgcagatctaccaagaaacgcgacgttggcattttcgtaccattttaaatctttcttcggttcttctgattcctctttatatagaccagatgaggttgttagtgaccaatccgcaaaggaagctccatacagtataaaagtaaaagaaagtgaatatgccccgaaagtaatgagtttacctggcttgtacgaatatatttgttctggggcagctttggccagtagagccgccattttcgtgctaaaagggattgacattttaattctaacaatttaacctttcaaatttccagatgcttcactgacccagtaaatctgagcactgatctctggaaccctggtgatatcgcagtcctgggtacagtttaactacgtacgttatgctctgcatgagctttaataatttttaaaagatatcaaattgtttcatcagcgaaaactcgattttgtatgggaaattctgaaatcccgatgattatgaatattatgatcggacatcacttgtgcataagaaagaataagtaggggtgcatgaaaatacactatgtatgcattgaatgtaagatatggaatatgacaatatctatataatatcgatagaaacttatttgttgaagtgtttaatcgcttcttccactcctcttgggtcagcaccgactaccttccccaatcctttcccattcttgaataatacaaaagttggcatagaagagatacccaaagcacccgcaatatcaggggattcatcgacatcgactttgtagaacttgacgttattgtatttttcacttagcttttgtacatgaggggcaacggctttacaagggccacaccaagtagcaaagaaatcgactaatgacaaattgtcagctttcattgcgacctcgaattcatgcaaattcgttagatgtttgatggtattcccgccagcagtagattggaatctaacttgggaaaaagccaatggtctcacgaaggttgcacgggaagctgtagcagttctcaatgcagttctggagatcatcgtaatgtctgtagcttgaattttatagggttggattttacagtagatagaactaaacctttctcgtatagcagtctacgttgattgatataattgataacagcaatgtaacaattgattttggcccggatacttcttctaaaatcaatccccgtctatgatttgtctcattcgacagcaacgatttttcattatttaagtgacgaaaagttatatcacgtgacttggatcaacactttttttcaattttcttatttggcaagcatgaatttggacctgacgctgttaatcgcatagcaactttgatcaagtagtttgatatatgagcgaagggaaattttcaatgaaggaaactgacgttaaggaaatatcaaccttgggaggatatacagttgagtcattatcaccattatataatgggatgaaaatggggacatggcgtttccttcaaaaataggaaatgatacgtggaagctggcttctcttgacttaagcttaatacagtaaagctcactcaagtggtcaatcgaatattagtagataaccgatgtctaaggacaggaattttacaggatgctgggcttgcagatttaaaaaacgtaaatgtgatgagcgtaagccaatttgttcgttatgccttaaacacggtgtggaatgttgctatgacgtgagattaagttggcttccagaaaatatgtatgttgttaaagataacgagttaggagtcatcagtggtaattctaatagaaggatgtccaaagagaagttcaaagaattgacgaatttgaaatatgatagtccaatatcagagagtgcaagtttcacaattagtgctaggagattcaaggtgtacgataattcaaggaaatgtgtgcatgaagataaccgtggtgccgatgtgtacgattcaaagcatgttgatgagaaactttccatatttttggatggattggaagaatccgaagagtttcaaagcggtccctttacgaaatttaagatacaacagcaggtttctgtgagaaaatgtgatccggcacagatattgaaatcgctatggcatgatcattcgtatcaattatcgaacaattggtgcctcacagaacccgaatatttacagaactttcagcaagatctacaaaaagttttactacggtgcgatttccccataaatgtgatcaacacgaattttgatgcagatcattggtcaaggctagtgccaaaactcccgaaacgtcatcaaagtgttgtcatgttcttcctttatgctcaaaatgtcaaaggttatcaacagattttgttgaattgggtttatattaaaacgactattagttctttagacttcccgttgttggttcaattgtgccaatgccaaagttcgaatcggtccactttaatctatttacgcaacttgattgctcactataaaccttccagtcgaaataatgagaatatttccaaactcataaaaatggaaatagagcaatacattacagcaattgacctttcgacgttaccaacacccatccttgatgcattcagtaacagcattgaatgggataataatgataattatatgaaactccaggttatgtgaacagcattgaactcccctttcactggcccgaatgttgggtcatttgtcaggtatattattcttaggttatataaaatcagcaaataactagcatgaacgtttatatgttgtctacttaatattttctaacgaacacaagcgttagcaatggaagcaactttgaaggcatctccgtttttgttagttagctttctaatttgttgagccttgtcatcttcatccttgaaaataacctcaagttgttcattagtactgaaatgtggttgcaattgttcccaaatcttcttctttggattcaattgttttataggttcttcatcgccgaaaccttcaaagaacaccttgtcaccagccttggatccagctgggggttcaacaaattcgacgttgttttcatcagaaccacaaagaaccatagcagtggatttgatacccctcatattaactggctttaagttgcaaacaacaacgacataacgttcttgcatagcttccaatgggaagtatttcactagaccagaacaaacggttcttggaccctcttcatcaccaacatcgatggtagaaacatatagagagtcagcatctggatgcttgatagccttttgaatgaaaccaacacggaaatcaattacacctggagatggtttggcagactcttgggctggtgcttgggcttgttgggcattggcggccttcttggcagccttctttgccttagcttcttctctcaatttctttaaagtttcttcatctggcttacctcttggttgtttatcggccttaccatccttctttgctgctgcttcaccgcccttcttggaagcttcagcctcgtccttcttatcttccttcttcttcttttcgatgacttcacgtggaagatccaaatcaatgttcaaagtcaagtcgttcaattgtaataaatcgttcaagtattgtgaccatctaagaatatgtctgtacttagcatagttacccttgacatctttagaagagttgatcaactccttggcaactggtaaaacatgttcgaacaatgtaacatcggagacggttggttgagcagtacccaaaacgaaagtgtgatccctcaaatgtagattcaattcctcaaaactaccctgaatgttcccagacttggcaacggaatcccattgagcctcaagagctttttgctcttgggtcaacgatggcgcagaaattgataaagcttcaaatttgttcaatagatcacaggacatctcttgctagtttctgtatggctaaaacaaacagggattaatgtaaaaagaaaatgtgaaaccttcttaatggattaatttctagaacgtaattaatagaaccagtaaaagcaggtgaagccgtattatggatgtatgcaccgcatgtaatcttgttctattggcatttcttgcctaagtactaaaaaaaattttggacattctcatagtcagaaagttggaaatttctgtcacgtgagaaatattaaagttctgatcagtgcattgagtattggttactgtggagattgacgtaaaggtgaattaaaaataaataaccaggtaacgaagacgtcgtattatctatgtagcagccaataatatggcattaagtgcttgaatatacatgactataccttttcaataagaagactcaacaaatgttgtaattctctcaggatctgtcgcttcctcctgcttaattttctaggtaagttttcgcttgatatatttgaaaagctgaaaaatcgatgagtcgtgcatggatgagcttggaataatggaactttatatatatatactaaagaagagaggatgagaacaaagttaccaacctatgtagcattttttttatataaacaagtgctgatataacatctgtaagatactgaaacagttacggtgtttttatatcttgtttttgccgttgtgtgaggcctatagaaatctgagttccttggatagctccgactggcgaattttttgatattggagacaattgtccggatgtctgtcaagaggaataagaaagtcagtgtggcctgtgtacactgtgccaaatcccacgttacttgtgatgacaaccgtccatgtactaggtgtatacggaagggattggaggaatcttgcatagatgcaccaaggaaaaaagtcaagtacctgcgcgatgtgccagaagatcaacttccttctgtcttaaggtctactaaacaggtaccgcctgtaaatgctgttaagctgaaaatggaacctggcattctgccgaacataccattagattatgatggtggtacaatccgacagtctgctcctgccaataacggtaagaataatccggagacgcaacaaactctgagcaacggtcagatcactcacaggcccaaatttttgtctagtgcagcagatttggaatactctattctatctgatatcattcatggggactctttgtttaataagattcctgtcaattttctgtattctaatcctacagagaagacaccaagcccgattaaccaaggatctctgaacggtcagcaagatctgcatttttcattacagctgcgatccaaacctatgaatcagataaggggaaatacaagagcaatatattctaatcttttaggacctgtttcgcatgagattttacagtcggaatttaatctctataccaatcatttcccgttacaacctcaagaaagtttagatggcacgctcgatttcaagcggatgactattgggactttgtccccacatctgacgaaatttgacaaaactataaaccagtactacttgaattttgctaatacttttccagagatatacgattcaagaaagatacctaatctttcatacgcactcgaagtggaaccaccagaatacagagagataccgcacgataccgagatcccgcatactttgaggttcactacaccatcagaaatatattcgttggttcaaacagcgtttccaagtactactggtttccatgcattgcttcgatatctcaaaagaagatttgacaaaaatcaattggtggaaatgtgtcgctgcttagctgagttacgaccaattttcattgccagtactatcgacctcaccgatgaagatatgatatttatggaaaagagccatcagagaactttattagagtatgagaaattcatctctcaggttggtaccccaacttgtgtatggagacgtaacggacagatcagttatgtgaatgacgagttttctctattgactggctggaatcgtctagaactactcaacaaaatgaccttcatagtcgaattgatggatggtgatacggtaatggagtacttccaaacgttcactagggttgcatatcaggggttcagaggtgctgaaactatgcgaatttgtaatctattaaccccgatcaagggaagcgttattaaatgttgttgtctatggacgctaaaaagagacgcctttggtttacctatgatgataatagggaacttcatgccaattctcaccctaccagaagacgttgggttttgaatctagaactgtcacaagtcaatagtatcggactgcttagaatagaacaaaagagcaaagctcctggcgtgtgagattgggtatttatatttatatatatatttgtattatactaactaatgcatgtaatcttgagttgcattacatcctctctcttattgtctcaatacatcttcaacaaatttcttgtagtcgatcaatccgtcagagtcgatttcgatccccttcatcaattcatcaacttcctcgtcagttaacctttcccctagaccggtcaataggtaacgaatatcacctggtgataccttgccagtattatccttgtcaaaaacttgaaaggctttgatgaaatcctctactttaccttgagtagtttgctccaacttctcttcgttatccttaactaatttttctagatcacctaaggtcaactcgtcacctgaagaagcgacaacttcctccactagcgcattggtaggattgtatccaattgctctcaaataatcaccaacttgggccttactgatggatcccttggcttgcttgtcaaatagcgtaaaaatatctttgttgattctggacatgatgattgatttcccacttcttcaatgaataatacagtactgcgtaattaaatcacgattcagtatcacttagcctagcaagaagtagatactatttaaagctccaaggtaaatataaatctattcgaatgtgtagaacaatgcatgccttcctccagtaaatatatcaaatgtaaagatactcttattgtttacgtttttcaaaatggaaaacaaattattgtttctggggcctcaaaagctctttttttggacgacctaaaactcagtcagatatcatttacccggattttaaatacccatcacgtgagtcaaatatattgttacccgcacaattcaacatcgcatttcgaaaatttccaaccttccctcgttcagtttcttttcctcagcatccaatgttcctgacatctgatgacactttttcttttgtcttcttgtcgagcgatgaaaagtgttcaagcttcttttttgatatgacctatataacaaaagcgattattaacatactcaataacagttttttatcgttcagtgtcgtatcacttttgttaactaagacataattttcattgttgtgttttcttttgttatagctcagtactatatcacagatcagtataccgtttaaactctgaacattatattgtgttccttcgttcatcagtaaaaaaaaaggtatgtgtgactactatgtccgattacaataggttcgggtttccctcagaggcgatggatatatatatattccctaaactctaacactattcaagattttagacttttacctataaaaaaagtctttggttcatattactaacaaattcttttgattattatacacagagctaatcaactgttcgttattagtgttttttccggttaaaaagaacatcttctttgccattgtctaaaaccatgtttagacttgtccaacaacagaccctaaagagtagggtcccaaatcagttcgtttctgcgtccagaaattctttaaattcccagttccgtttcaacagcgctgtcgcactagagcgtaatcctcaacaggatccaacaactgcagcaccagccaagtcgtcttcggataagagaaactctaagaagaagtatgaaaataatgaaatcattgaacgtaacgttaaaaaggtccgcaacctaagaagaaacataaaattcgataatttcaaaaactctcctaattctccagctttctctaaacttaatgccttggatgactgtttggccagaggtttggaagcatcttcctctcgtgcccccgatggtaaattcctagatcaatcttcattgttttgggattcggtcagtagtagtatgaatatctacagggagttagtcatcaccggagacttaaacaaccatcgtgcaagtagggttattcaactcatgcatgttgctttgaaggtcaatagaacccagttgactagcatgaacaagaagccagattatgattcgcaatctttccacaaggaaatgaccaattatttgtgtgaatcgcttagggaaatctctggtgatattttagctaaccgtgtctcagtcagtgaacacggtgccgctcatttgttatcctctttcaaagaattactgctttacgaagaaactttgaacatctggaaagcagctgtgaattctgagaacaaggatattgtcaaatctttcatgtttccaaacgtcgtcggtgtcgttttaccattactatatgaaaacggtaccactttcgaagaaattaagaaattgtatgaaaagtccgctagtaatacaactagatctcatggaagccctagtttagttttgggtatgattaagacctcgcttgctgccaacgaaaacgagcatgctttgtcccttttccaagagatgtgtacatcggaaggatttggtgtttcaccatatgcggttttgacgggaactcatttggccttcattggtgaatgtaaggatttgtatgtggctaagagtttcttcgaaagggctttgagtaaagacatgccctacaagatcaacttgcaggtttcttcagtgaaacagttaatccaaaatatttgggatcaaacccatgatttcaacgaagtcgttgatgtttggaccaaggctaccaaatattatggtaaagatgtttcccatggtatctcatcatcattgaactctaagttcatttcaattttcttcgaaaactatgttaccgacaaagcagctggtttacagcaccttcaagagttggtaacagcgtatgacgaaatgaaagctatcgatgaacccttcttgaacatcattttaactaaatgtaccgtttggcaagatagaaatattatcgaatctatcgaaaagtcatacgagctataccacattccaaagaccatcgtcacctaccgtattatcttgaaggctatgggaagtatcagtgttccaaatgatgtcatccgtgagaaatgggttcaattaatccaaaaagctgatcaaattggccagacgtatatcgccaatgctgattgggcagctctaagagatgctactgtaacgtacacccaagaacagtttaaaaacggcggcagctatgaaatgactacatctgattcttataatccagctttggaagccgctaatgccagtggggcatttgatgatttcaatgaacctacctccggtacaaaacatgctgatcacttgaatactcaaaccaataaagaagataatgacagaattctactttactaccaattggtaaaacgttacggtgtctattgtagagatcctaagcaatatgctcgtattaccagtggtattgcattgaatttcgaagtcgcacagccatatcttggtttggttaatacaatggatgtctcatcgatatacgttccgccattgaggaatttccacttgaatcactgatagatattcaataataatttcaaacattcattttatcaatttaactacattgactaacgatctttgtatgttgtctgtaaatatatataatatagatatacccttttccacttatgattaatctaatgaaagcttatttaaacacatattcgtctttagttgacaactcaatcgggaagctatatataagttattgtatattttgcaatacttggttctacataaaagttctcttaaaatatctaagagttagatcgtgtgcatctcttttaaggtaaaagctgaacaaaaatcaatttaagttgaatcatatctacaattattacaaacatagatataaaacgtacaggatagaacgaaaaaagagaagccattgctaagtcatactgccgatgggtctatgtggtagtaagcctagtaaaggtgtgccgttggccgctgatagttcagcaccaaaatcaaataacaaaactacatcaaaaaagagcacgggaagaccgattgatgtcacgcaaagtcaccataccttatctccaagagaagctgcaagagtggccgctgaacagcgaaatgctaaacttgaagctgccaacgccaaaagtgaattgagtcagaaactagcccatgagcgtgccaaatccaggaaaacgcatgtgatggaaattgcgcagaaatgaaacatgttggtgaatgattgaaattgaaactaaattacatacgatatttacctgattggatatccttcactgctgcttttcgtattccctctttaacctttgtattgaggagttctaatgccattgttacgtcactttcttctgcaccttccacaatcaaatacaatttaggatcatcagtgtcattctttggcccttttccttcagggtagaagctacctttactctcaaaattacatcctgtctcctgtttgatgttcgagactgtctctgttttcgttgcttcccacctcgcaagttgcggaaggtcgttaatatttatatgtgcaaaatatgttgtggaatgtccttcttcccttttacctcttgtgtattccattttggttgctccgctttcttcctctgtcacatcttcttcattttcaacgacaccatagtcagtatattcttgagactgttttgcttcgtttagctcgtctaagtgatcaagaccttttccaccaaaaccctggatcaatctgtattttccagtctttagtccactcgaaaattcgtcgttcatttccttcaatttttgatagacaaccatcggcacagagctcaactcgttctctttcatgcacttcaccaaaatataggcagatgcaagttcatcaaccataacgaaggagagcgcaacgccgttattagtcccacgaccagttcttcctacggtatgaacgtattgtgcgatggtctttgccgcattgtatataatgacaagagaaacctctggcacgtttagacctcttgagagtacctcagtacatatcaaaattccgttgtcagtttctttgaatttttgcaagttgcgaagacgttctgcagaaggtttgccagcatggataggaaaagtggtgatgccattaagtaaaagctcgtcatataaaaggtcacaaagctgctggcttccaacgaaaataattgtcttttcatcttcaccacgatgcaaggctaaccgatccgaaagccttttaagtaggaactcaaatttaacatgttcctcatcaaaaatttggactctctgctgaatgttctcattaataagtgatttagagtttatagtaatttgaataggattctttaaggttcgcgatgcaaaatgtttgagcttacttggaaatgtagcactaaagagaacacactgcttgtctggacggatgcagcccataatttggttgacttggggtccaaatccaaggtcgaaaagtctatctgcctcatccataacaacaaacgaaattcttgtaggagataacaaatggcctgaatttaatgtcataagatcaatgaatctccctggagttgcgacaatgatatcaacacctcttttcaattcattgatttgttgctttaactccgagcctcccacgcaacagatgcttgaaatgccagaccctttacaaaatttaagtgcctcttcttgtatctgaacggccaattctctggtcggtgtcaatataagaccaataggaccagtctcatcaggagctaaaggtggctgagccttgatctgtctaacaagtggtaggagaaaagcgaccgttttccctgacccagtttttgagataccaataacatctctgcctgacataatagccggtattgcctggcattgaattggtgtgagggttacaaactgtagttcgttggagataagatccatgatttcagaggacaaaccaagctgtgaccatttcgttacaggtttgggacaatctttccctgagattttaatgttatctaatgataatcgaagttcctccacatctttctctgacatcaatcccaaatcgttcggttcacgataaagacatttatttaatgttattaagtttaaaactttagagtaatcaatggcttttattttctttctacccttctttttgaataatatctctgaatcaaccggagcttcctcttgagatatcgttttctctgagctactgtcgttagcatcttcatcctctgaaatattatcaataagtcttactcggttagtattcgaatctttatcgataagcttgtggatatattcatccaatgcatcattcccatcatccaaatcatccttgctgttgtcttttgtcagaacatgagtatttgtatcgtttctacgcggcttgaataacgttgatgtggaattttcatcatcagattcactatcacttcccccaaaagcaggacgttttctcgaacactgtccccttcgtttgttcctgtccctatccgcagactttatactggtaagttttatatccttttgcttgagttcatcttgttgtttcttcttcttcttccatgcctctagtttcttcagtctctcttccttagcatctacagaaacagatgctgtaacatcattattcagtttctgttttttccacttagcaagtttctcttgcctaatccgtagcttttccgtttgatccataacgctcaccttcgtaatttaattgggtcttttttcttctttctgtgtgctatctttcaagtattaatcctgaatggttttaaggttttgttaattcaatattataggtattttgatattgaaggaaatcctttccaaatgggtattttaaactactaaatgaagatgggaaacacgctacctagttcattgcattcagttcatatgacaattgtctatattctttgttatagtgtctaaagttgactgatcttctaaagcatctattcattatttcttcatttagtcttaaataacaacttccaaagtgacatctgaagtcaaaatgtacaaggattaaaaaatgctatatgagagcagttgaaaggactcttcatgaaacattcgaatatggaaatgaagctgaagcatcctatacgttaaacagcatacttcttttgtaaatgcctgatcccatcattccctaagcgatttagccttttttagtttagctttcccgttaatatttctatatagtcgatctttagaatgtcataaaagtagtttcattccaagaaggtaacactgacttggagttcaataaggctttcgaaacaggccgcgacatatcaattgcgcaagctgtcagcatggtgttactacctgagaagccagtatggatgtcccagcaacaatatgaagagcaatatggttcgttgcttaaattgaaagaatcagagaagtgcaatcatgaggacaaacagctagcattacaacccaaagaaagtagcatcggatattcgacgcaggaaagaatagcaaagctttcagtaccagaagttcaagatgacgacaaaaatagcaaggtgcgcaacaggaaacatcagcgatttgatttagaagagaagaagaaaaagctgaggctgcagaagactatagaagaacaaataaaacatcatgatattgaaatgacagctaatagagtcgtgaatgttgaccatgttgtcaggcaacattataatgagcgtacgtttctttccaaaaagcataacagaaattattctcctatcattaaacttagaaactttaataatgctatcaagtacattctcattgacaagtttacaagagcaggagatgtagtcttggagcttgcctgtggtaaaggtggtgatttaaggaaatatggtgccgcaggaatatcacagtttattggtattgacatttccaatgcttcaattaccgaggcgcttaaacgttatcattcgatgaagaaccttgaataccaagttattctaattactggtgattgttttggtgagtcccttggggtcgcagttgaatcattcccagaatgcagatttccttgtgacatagtgtcatgtcaattcgctctacattatgcgtttgaaaccgaagagaaagctagacgaatgttgcttaacgttgtcaaatcattaaagattggaggatatttcttcggtaccatcccagattcagaatttattcgttacaagatgaacaaaatacctgaatcagtagaaaagccatcttgggggaactctatctacaaggttacgttttctaataatgaataccagaaaaacggcaatgagtttccatcgccgtttggacaaatgtacacattttggttggaagatgctatcgataacgtccctgaatacgttataccgtttgaaagtttcagaagtttggcagatgaatacggtatggaattagagctgcaaaagggattcaatgagttctttgtggaagagatccctaactgggtaaacagattctcacccaaaatgagagagggattaaaaagatctgacggaaggtatggggtggaaggtgtagaaaaagaaccagctgcatatttctacacaacatttgcattccgtaaggttagagactatcaagagtaattgtatctggcgacgattccttgatgaaagttaatagtgattcatctataagcctcttaaatactaacttgaaagatattttatatattggaactataatgctgttgtgacagtcatagattgtgagtttattagtatagttggtggtaatccatccaaccaaatatcaatattttgcacatactctagacttgccagttcatttttatgtgttcccaaaggaggcaaaggtagggtcgaaagcaacaagtttgacttagaggaaacttgtgtcatcatatcatgcaaaattagatgctgtaccctacttggtaacatattgaacgtgagttcatccgagctgccggtgagatctgcactagattgacatggtgatatcggatgcaacacaggattctgcttgatatcagtagtatgatcaatgacaggaactaatgtaggttgctgaccagtggcctcttcaatcacttttgtttttggcattgctttgctcgaaaatacaggtctgtttgatcttattgatgcgttatcaagagctttcattgagcgaacaggatgaatgctctgattttgatcgccattgctcaatagagtagagtttgattcataggctcccacggcgtaatcggactcgtattccgattcattaccagccatatccgtagcaggcatgctggaagccattgtcaatgatactcctagtctctgcaaatttgaaacatcatatttctttttcaaatggttgccattgatcttgatacttgttggctctgtagtagtgaatttcctattagaatgttgtcttgttctcgcatcgactaattctctccaccagtcgtcattcttgagggcttcatcaacacatttcttggcaattatatctgccttgacaatggtattgtacactctgaactggtccaatgataagaccagaacttcagcttcgattctaagcaccgaaagtaaagcatcgattctctttttctcatcgtaacgttctctttcattttcaacgaatactattacacggagctggtgagttctatgccaatcgggaacggtagttaatattgcccccaattgtaatataagggtatacgtgtcgaagttagtagttgtaacttctcctgaagaattctcattaacaattgttgcggacatttggattggatagaggtctatgtatcctttagtatcccttgtttcgttcttttgaggaagctgcaagtttttgaatccataagcaaccgcaatgttactacgcattaatgagagatcttcaataacctgaacccattgttgaagtttgactttctcctcatttttacactcatctgtaggtagggactcaaattcaggatgacttggcatttctatcgaaatagagtctttgtactttgtcactctgaagttcatatcttcccttaaagggctagaagcgccgacaccatgcggtcttttcttctgtaaataattgtttaaatcaaaaaatccaagcacagtgatattgggcttcatgcctcccaaaccggaacccatgaaaacgtttctgatgccccaaggtagagtaggtcccatcccaatttgaacaaaggctttaataccggccatatccctgatatttacccaggctctcatttgcttattgagttcctgatactcagattggaaatttgacgctactgtaacatggcctaggatatacaagccaccttttttcaaatgattacagaacttgatcaggttccaacttgtccttggattgtcaaccataagcaaaacttgaggtctccaatattttacgttgtcttgtcttaatctcaatagatattttctcacttgatggtagattaatgattgagaaacatcaccccagggttttggtggacaaaaatagtggataatgacaaataatagacatagagaagatataacagcagaggctgaaacattgtccacaacgtacatggctatgatacagaacatagcgcccaggaatgctgtgtatctattgaaccatttgaaagatggtctgaagttcggagctgatgaaatttccaacaagaaacatgccatattcatgataatgaacgtcattaagaaagtcattgtgatgaatgtagcaattttgttcacatccgaaaacaagcacatctgagttagaaaccatgagaaaagtaagcaaagtactggatttctgccaaatattgagataccaggcaaaatgttatcctttgagattgcttccaacacataagcagcacctaccatacccactatgacggagaatagagaagtggaaagttcaccgaccagaatgatgctttggaaaccggacacggtctgtataatttgcacgtctttatgcaaggatttttttgggactgaacagcctaaggatataatgacaagcgaataacacacgaaggttaacagaaggccccaaagggttcccttaggtatggatttggaaggcttacgcaattcactggacataccggcgccagcaaatattcctgccgtagctggaaaaaaaatcccgaatagatcattgaacgtttcgtaacccttcaacaccgagcctgctgcaccctttgtaaacttcggatatagattttgtttgagtatctgtaaagacggtcctgtgtacacgattccattaagttcgaaaggcttcacaaataaaacagagataggaatcgagattgtagaagccaatagcaaccagaatagaacgttaccagcacgcgagacagtctgtgaaccaatcatagccaccgccagacataacagaagcaaaaccgtagagtatccaaattggtaccaatgcccttctggaagtacttgagttagcacaccttccgagataccaaaattgtataacaacggttccacgataccaactatgttcataccactattcaaaatttggccaatgaaaaagataagaccaatagaacctccaaattcaggacctaggcatcgtgaaatcatgtaatatgcaccaccacctctcactgtaccgttggtcgatatagctgaaatgctcaatgtggttgatacatcaatgataaaagataagattaacaatagaaatgttcccaaaatacccatctgtcctattatgaaaccaaatctcaagaacattaaaattgagagcacatttaacgtagtgggtataaatactccatcgaatgttcccaatttatttctatggggattctctagatcatattttgaagattgttcttgttgtaacggtgtgtcttgatatttgaaatacgttaaactcgaccttctcttaagcaacggtgagcgctctgattgtgacggaaggtgcgaacccggtagttcatagaacttagacatcagtgtggtgacagtgcactactgtcgttacctttgccattgaaaacactgctaatctgaatatttttatcgcttcgttatttatctttgcttgatttgacgaattcctttaagggtctatcatttttgaaagatttttgaaatttcaccatagagcaagaagagatttgaaatgcagagagattgatggatatggttcgatcatgtttgaagcattcaggcatgctcagaactaccatctaacaggtgaaaatcaacgaaaacgatgactacaagataccagagggttttggagataaatgccaaagagaaaatatctctggcgatcgttaagttccctccttttaagctacgtgcggcgatggttgagaaagatccggtgatatggctccatttgctggaagtttatgtgcaacatatgagttatttattacatggtgacaacttagactttctcagtgatgagaccattgatcatctatgcattttcgttaaggcttatgtgcatgaaatgagtgaagaagaaggaaaacttctttctttgggaattaatgcagatgttttgaagcaattagagcttttaagagcttacgttttacagttgattaaaagctgtgggctactatacttgaagttgaatacagagtctctatgggacataacacggtcctacgtcgagggaaatgcaaccactgtcagatcgttgatcgaaggatctttaagaccgaccattaatactcagaaagcacaattggataggacgtaccagatacagcaacatataagatatttgatagaagccaataaatttagtagagtggatttaaagtctctggaattgcttttagctgctgatgataaggcgaagagttcatttacagataattttgtgtctgccaagtgggttgatacattagagtcaatgtatggcaaggaaccagggagttatttatcagattggggaaagaaacttggaatattaagctttttgtcctgcagcgtcacacatttggctgatttgttaaagcaaatgagcataacgaacttacgaacactttcaatgtatccacttttagggtcacttctaattgatgccaggtttcaggaaaagttgccacatattaaaactaaaatcccctttttggatatacaagaggaaccgaaggcagctccccatttaagcggtctgctaatgcctagtgtcaatgttgaacaaatagacacaatcaaggaactatttccggaccttacttctaaccagataacaaaattattgcagaggtatgataataacacggaagttataatcaataacttgtttgaaaatccatctgtgatatcttcactcgaagatgggccactgcaggatgacgaaatacagaatacgaccgaaaacctgatggaggaacataagccgaaggagaatttattgccagccatcactccgaaggacaaaattgaaaagaaaaacatgttattccctacaaacgacgtacctgatgctgtcagaaacaaaacattatcaagagctttatcccttctatatgatgccacagaagatgaaagggatgacacctacgacgatgcagaagttaagcaagcttctgcagatcgtgtaagcgtcgatacttctgacacagcaaaggtatcaaccataacaccaggcacatctaagtacgataaaattgaaggatatctatgggaattattgaaaagggataaaaatcttttctcccgtcagcaacggggctcgaaacagcggaaagaaatgaagaaagagactaactggtctgacgaacaaattgaaggttggtcaagaatgattgagaagagtccaaagagggcacaactgctagaagaaaagtatattttcaaagggaacgttcggcaaggcaagaagacgtttacaaaagcacgagaggataaagaaggttttgatcatcatgtagttgacagcaccgtaaattcacctaacactaacagtaataatgattctggcagagagaaaacacctactaccaaagaacctcttaccaaagaacaacaaaagagaaaaaatgctcgtaacgagaaactaaaatcaagtcgtgctaatcataatagaaaagcgggacacgataaaaagttagctaaaagtggtgttttatgatgaacattagaccagtatagatacatttacgaaaattgaagtcgattatcctgtatcttcctatttatctgtagatattatgaaatgcatttactttaaatatcattcttcgaaactttccttttcttggattctaatttattccaaagatcctcattttcagcatcttcatcagcttcgacgatgcttcttttggcttccttcttcttcttcattttcaattgcttttcagttaaaggtaattccaagtcattgtcttctaagagtataatatcagaaaccttaccgcctgtgaatatctttgccaggagcttataatcggctaaatcaaagatacgaacatacctgtccaaaccaccttgaagtaagtatttatcggtaacagcaatgcaagatgcaaaaccagtaatgtcgcccttggcaatctttctcaacaagcgtcccttgccgttgaattggtacacatcttttctggagtctgctgctaagaattcaagctcgtcaaagttagaactttgaaagttacccagtggggatgtgtcgcctataattttgcaagaattcaattgctcacctttgggtagaagagtaatagatttcacaggtctacaatcttcagcgttggtggaatactttcttaattgagcatatttcgtaattgtaatgaaattataaaccccgttcttttctgattctaagaatctcaaagcaacatcccatgcaggaactcttaacccaatgttgtcaaagggaacatttttagcagcccatatatcagaaatttctttgaaatcggatgataactcgatcaacctaactagattttcctctccaccgtatgccataacgaacttatcagatttatctaaatcataaagtgtaacaaactctacaggcgcctttattttatgagaagctatcttggagatcttagttgaatgcaaatcaacttcgatgatggtcacatttccagatttcgttgctgccaagaagatggggtttttagccgatttcttaatcaaatatagttccacaaattgatcctcgatcttacttttcttctttgatttcgaactaagtgtatccaacactgactggtcaaaaagtcccgatattagatcttgaagttcaaattctgtcacatcatatttcggctcatttgtttcatcaacatccttagaaaccctcttacttgacacaagttctaaactaccactatgtcttgctaagagtaacagagaatcagaaacatgatatatcttatcaattctgttggacaaaccttggtttaaatgaatgtcaatatggaaaggctgtagtgcagtcttaattgaggtgtttgtgcctctgttgaaaataatttctttcaatgagccactatcatcactcgccaataaaactctcattgttagttcacgtcctggtatttctagacggagtctcaacggcaagtactcttatatatatcgtacctcatcgccagtgttcttatgccaatgatgcgatgagctctaaaatttttcaaaagaaactatccgggaatacaaaatcacgtgactgatatcaaaaggtaaagatggcaggatgacggttaaacccatgacaacctttcgctctcaatgtgaaccaggcttatggattatttttaggtacatcaggatcgtgtaaattccagcactggtcaatgatgaaaatatacaccgtttgttaaaggtattagtctgtataggggcattcgtgcaagtgaagaaatattaagaagttgaaaatcgttcattattactcagataatctatatgtgcatcccactttaataagggtaaaatgattgtgcattcttctgaatctacgttaattaatcgaacagttcattagtcgagagtctcctaatgtctgatatcgctgctcaattcaaattggtcaaaggatctatttattctcactgtttcaatcaggacagaagccttttggcaatcacctatgatactgattgttacgtttacaaagtctctgctgcaaagcaacctcaattggtagcagtactaccagatcacgacaagactgttactgctgttgatatttctgttcacggtcgtattgtaacttgttcacaagatcgtaatgccattgtgtgggagcccttatctaatggtacttataagccaactttagtcttattgagaattaacagggccgcaacctgtgtttcatgggcttcatccggttacaagtttgcagtcggttctagtgctagaatcattgctgtgtgctactacgagcaggagaatgattggtgggtttccaagcacatcaaaaaacctatcaagtccactatcaatgccttgtcatggcactcaaattgtgtccttttggcatgtggtggtactgatggttacgctcgtgtgttttccggtttcattaagggattggataccaaggaacaagttgctggctctccatggggtgagaaattcccatttggttctttggttagagaatggtaccagggtgcctggatccacgatatcaaatggagatcttccatcgataaggtcgcatttgtcacccacgatggttccttgaatatcactgattacactgacgatattaagagtgtagacaacccagaaggtcttccattcatcaccttatgttggatcaatgatcatgaaattttagcagctggtttctcaaatcatcctgttttgtacagcgaaggttcaaggggttgggaagtgtccaagattttggatagcccagttaagagtgctggcaaattggtagcatcaactggggatgatgaagaagaaggtgccttcggtatgtccgcattgagaaagttcaaggaattggatttgaagggtaaagttagccagcaagaagagaaatctacccatgtgaactcaattacagaattggctgcttacaaggaatctaacaacaacgtcactcaagtttcttctgttggtttggatggtaaacttgttatatacaagttgtagatatggacggtaaacgattcatctcttcatcaaatagttgatcagatcacccctataactcttacgttcagagtgagaatacaataaaaaagagtggccttagaaatgaaatatgtatatctatgttcatatatattaaaatgtaatgttacaactctgattatgattacaataatcagtccgattccgctcatagatctgaaggtttttgttggtgatccatccgtcgctgtatcacgagtgaatatacgctacctttgagaagcgtacttacaagagatattttcacttcaatttctcgcatctcttgtaaaattgcttccggttttgagtcctcatgggtgttgtttagatctgaaagtgtttcgctcaattcccttaaggactccgctaggaagcgatatttatcgagcacacttcgctgcaatggtgtcagttccgaagacatattcaaaacacaaatagtatgtttctttgtaatttgtacgtaagcccaaaccagtaatggttacctttgttgccttaccttacatattcaattggaactctatccggtaaacttatgataacgttatttcatttttggtattttccaatattgacgaaaaacataaacgatcgaatcctgaaagaataacaactccatccttcaaagtaaggaatacaaagccaacgatttgaatacaacaccagcgctcctctattgcacgaacatccactcgaaaactctagtttcaggtgtatacactgaaacagcgataaattttattcgagtaaacggtattcttttctttattcatttgtgttcaatttcaataatgtcacagcagtcctctcagcaacaatcttatacaatttggtccccgcatgatacggtgaaggatgtggcagattcactcggaatctcaaatacaaatgatgacgtgttgaggtcattggcgatggatgtcgagtaccgtattttggaaatcgtggaacaagcggtgaaatttaagagacacagtaagcgatctactttgactacaagcgatgttgcgaaagctttacgtgtccttaacgtcgagccattgtatggattcgaggaaggatcagcgaaaaatgagcccgttaagttcaataagttggagggcgctaatgggcagacgctttattacctagatgatgaggagatcgattttgaaaaattgatcaatactccattaccagaagttccaagattaccaacgttcacggcgcattggctagcggtagaaggaattcaacctgccattccacaaaatccaaatatcaatgaactaaggctgagtcaagttccgttgcaaagaggagcaatagtctcaccattaaacgaaacttctgttcaaacctctttacaaacaaatgtcaatgaagaaagacaggccaccgcaaatggacctatctcgacacaagtgaaaccaggtgcagcaagtgaagctaagccattggtcaaacacgttttgtctaaagaattacagatatatttcgaaaaagttgctagtgcacttacatcgaaggaagaagatatcaattcacaacggatgagagcagcagctttaacttcgttgaagtctgacacaggactacatcagcttgttccatatttcatacagtttatcgcagagcagattactcaccatttagaggatttggagttgttaactacaatgttggaaatgatatattcgttattgagtaatcaatcagtatttttggatccttacattcattctctaatgccttctatcttaacactactattagcgaagagacttggtggtaatggctcgaaaaactcatctgacgacaagattgttgaccagcaaaataaaaaagagtttttagagaagactaatgctgtccgtgattttgctagctctttactcgatcacgtcttgaaaaagttcccaaaggttcacaaatcgttgaaacctcgtgttactagaactttacttaagacattcttggatatcaatagatcattcggtacttactatggttgtgtacgtggtgtttctgtcctcggtaacgaaacaataagattctttttaggcaatttacaaaactggtcgaaactagttttcgaggaatatgacagaagccaatcggaagacagcaagagcggaaagaacctaactgacttggagataaaattattgtcaacagtgatagtgtccactttagagaacttgaaatctgatcttccatcttcatacaacccttctggtgattttagtgaggaggacaaaactcgtttgagagaaagatgcggaattactgtcggcaacgtaatactggaaagagacgatgcaaagactctatacgatgctatattttttggtgagctttagacatcaaatatgtaaatattgtaacgaatatacgtattaactacggcgcaaataatctcctacggacgtgcctggttttaacctttactggcgatgccctaactggtgtttctgaaacaactgaaggggaagccaccaacactggggtgtccttcttttcctctataggtttgatcggagttgctgtaacatgtatatcctgctgtttatcatcaaatccggtttctgagatatagctagcaagtttacgtttaccaactcgttggaaagagttattatgagattgagagatattgatagcttttccgtttaccaaaacagttctaacagtgctgaactcctccaatatttgttgtctttgcttgacaatatcgtctaaagaaagatcttgcacagacatttgtcttttttgaaggcgattcagtttcaaatccgacgacgaccttgacgccattttgggtttcttctttgttgtttcctcctccaaaaactctacaaggtttgagttcgttctagttcttaataatggaggcatttgtggcgaagagcgctttccatcgctgactgaagatattgatccagctcttgatctgttagaattagtttgctgcgcatttgtcatgggttttttttccatagtaggtcccttgattttattcgttatgaaagtgacaacaaaaggcagtttcttataccaatatggaacaacgacgtaactgagaaaacctttggaagatatttctttatttttattgactattccttgtttgtattcatgaattaatttgtttattggcggctgttcagaatgcaatgatatttcggtagatatcaaggcctcggctattcctaacttatccaaaaggatatctaaattttgacaataatcgattactttaagttgttttacggacttgctagactttcctttatttcgtcttcttgaaaatcgtgtcatggttgtcatcatattaaaagacccttcattaagtttgtttgcgtggtttgtttcgtattgtttaatcgtagaatccaactttccttctgttagtaattccaaaagaatcataatctgcagttttatatccctaaccttcagtatgtttgagatgtctgatatgacatcgtttaagttctgcatcctttcaatatccaccccaagagtatcacgtatgcttctaactcggaagtctttgcattcatcagggatgctctcatattttagcagaccgcagtgctctaggtgatgtctttgttcaaaagttgattgatctacgagagaagacttcagtacggtttgatacgctttcccatgccgtttacatagaactttgagtcgtgaaagtttcgatttaacaaaatgtgccagcggatcgttgagggagtataacatttcataatatttctgttgaagatatgaactcggatccagttcttgacggtgaataaatgatccactaccatgttcatcaatcaccatctctttaccataactaaagcccggaggtttcataaccagaggtaattgttctggcatgtcaccatcaggaattttctgtctgtcttctttccaatacggaagtatgtcttcgatgctcagatcgcaccattcgtcaagagtctttacgtcataacgtgtagagacctgctctttataatttggtttatcgtgaccgatactctcctgattgggtacctttactaatccccatcgcagccaactgtcttgaaagtaatgttctagtatgataaattgatctccattccgtagtaaatgttttaacacaacatcggtcgcttttatatttgcttgcacttgttgaaattctgaagatttgaggtctactaaagtaaccgaggtctcatcaatctcaaaaccagccggcagtttgagaaatgaacaaattaatacccactgccttgcggaagtatccatgataccaatgcaatgtggataacgcttattcacagcttttatttgttttgtttcttatgtatttcttgaagacttcttccaagttttggacaatgcgattttaacatcgagaaatctcattctgctaattgttgaatattcatgagaagtacgaagcaaagataaaaaaaaaaagtatctacgacaacatcacatagtggtattagaacgctttatcacatttgaagtaatttggcgttaattttatggaatgttttatagttgattccgaaagagagtagtttatcctcgtttattatatttaacatttacaaacgttgctaataatcgaatctgcagttgtaaaacgcctataaacaaacacgttcaataatacaaagtgtaccagtcactcgtcgttcattccaatggtgatgttttcttgtctttttcttttatccatatcaattctgttattgatcatcattatggcagtttgggttgccaaaggagttccgatcaggacaagttttctttcatcaagaccttccacaggatcattaattttaatcatgcatcctgttgattgtttgatctgctgaatatttttaccaccttttcctatgacgttaccaacaaatttgttatcgatgaacacctcttgtggtaatactaagtggggagagataggagattgttgtaactgagagattattttgacatgcttacacgagtcaaccatatcagtatacggctgaagagactgctgtggccctattgggtatttggaaacgggtggtttcgttctgcgattcattgtctttttgtccataggatgatactgatgatgctcctggtggggtgcgaccatgggtgttatatcttgaggattagtcggagcaccacctgaataaatcatgtacatctggtaattgttgactagtacagaatgcatcgggccaggatgataaaataccgattttttgttctttagtttactctcattttccaatattgtttgaccaatgtagtaagtagcaatatgaatcgcgtctgcaactccggtaagagacaaaattctatcattggacatgggcagttgttgtggacttgccataagcctagcagcactcagatcctcgatttcgtggagcctcgaaccttgtctaccgattatgcaccccataaaatggtgaggaattagtaaattcaccactaatggcagagatctctcatttgaatcgtcatcactctcattattaatagccctgacaattttcccaaacgctctggctacttcttcacactttcctcgaacaaatattaccctttccatgacaccattaatgttgtctgacacattaattctcgtgtttgtctcagattttatcctattaacacgttctccttttcctccaaccacttttgaagcctgcttcatcaaacataacatacgcaaattaatataattaggaacttgtccagagtccttctcagtgagatgcgtgccatctccgttcaattccgaattttggggctcagcctcgttgtcttcaagagcaactctttttattccagcttctagtgtttcatggtcgggtttccgttttaaagagttaggtgagcttacgggctccaagctcaaaacttcttcatccgccataatattatcaatcaattggcaaatactagctccccttgtcgttcaatctgcgtttgttgagttgtgctcgaggccactgtttacagtaaggttcgaagactagacaagtttatcaaaattcaatttcgcttttatttgttgaaattgaaaaacagacatttgactgataaccttgagacaccttacctcatcgatagagaaacaaaggaggaatagcgtcgagtgaaggtttatatccttagacaataattacttataagtgtggccgacatctattaaacataaacagacatgtctgacaccaagggctctgacctgaacgaggattctgcattagagtttgatgaggaaagttatcatgaatctgaggatgaggacttcgatcccagtaaagagcagaacaaaaggaaaacaactaatgacaataaaaaaacagacgtcaatgccaatataagtgacagtgatcaggacgaagatgaagatgaggagtatgacgaggaagctcaagaagaagagaagaaatatagcagtattgttagcgaatccggcggcctcatcaaaactagaagggcaagattacaagaagagcacgatgctttaaagaataaatacgaacaaatagatattgcagaaacttccggaaaatctaatgatttatggcgtcagttgaaggaacgagcacttagtagatcacaatttaacggatctgtgatggatcaagatgccggttcaataacagattctatgcaagaacagaagatattgatcgaacgtacttataaatttgcaggcgaagtaattaaagagaaaaaatgggttcttcgtcacagcgcagagggtcaagaatatctcaatagcatcaaattcaaaaccggtactctcgataaaaatacggtaccgcctgatactgttaaaaatactcaagctcaacaaactgaagggaaacaaaatagagttaacgaggcaggacgtcttttaaagaggcatctgaaaaggcctcctattcttgagcaaataatagccggaaatctaaagcctaaactcacaacattagagaaatcccaactcgattgggccagttacgtggacaaagaaggtattcacgaggagttaaaccttcacaacaaggacggtttcttagcaaaacaagatttcttgaatagagtggagtcttccaaggatcaaaaatacagagaacttcgaaaattgcagttgcaaacggagcaacagaaacagtaaactcgtaataggaagtaacgttaaattaatgaattataaaatagttgaacaaaaagagaacacttaaatggtatatatatctttttaatcaaaaatgcggtactccgataccggtaaagaacatgttaactatgctgaatatcccctcacccaacaccaatcctgaactaaacacaatcattttcgtctttgcatccgggtttcctctgttggtacgtaaccagatgtgagccaacatgcccccagcaaaacgttctatggtgaaacttggagagttgtaaatcccaacacctaccgcaacgccagatggaatccacaaaacccatttataacctctgtcacgaagacagtttttaattaaagataaaacggcaaatatcgatcccagtactaaagagcactccagtgctttatcaggcaagcttttaccagtaactaacctggcacaatcaatccacacaacagcagttggtattctgaattgttgattgggaatgtcgtaaattttattgtacaacttgtaaactatactggacaaaacaatggaccaagctgcgcctatcgattgtgcaatgaattgtgcctttggtgatgctcccaacaaatgcccggttttcaaatcttgcatcaaatcccctgcctgttgagccccagcttctgcaacgccacccgccacaagattcaatagcacgctaccattctggctattcggaatgattaatgcgaacaacaattgtgatagtttaccaataccacttacaggatttaaatcggtttcccctaatgcacgaaccgctaaaatagaaagaaaagaagctataaccagggccgaaacgatggagtacaatggaatgatatcaattccaaacaaatatatcattactgtgacacatagtatgaaagaaattgccaatccacttagcactgtagtataggctactaaatgtttggaatcaacttcatgatcaatctctgtactgactagtttaactgtattttcatgtctaccccgagaatcgttcaacactcgttcttcttcgagtaacatcgattggatagaatcatccaaaacgctattgaacatttccattttgtcatctaagaggatgaacttcacaattgatcgtatcgtgaaaacgatgaagcccacaacactatcaaccaccataattgaaagcgatgtccagataatccatccttgaaccccattttcccaatcgtgaacgttggcttcaggatctacccagcgattgtaccttgctagaggtgccaaaattccccaccctaatatgcatccaaaaagcatatatgaaaccgtgggcaaccccatgataataccttgaccaacgtatgcaggcgacggctctatattccatagataaacgtccgaagcataatttccaaacatcgggattgacttcactgccggtacgaaataagaagtgacggtatataatgcagaggcactgaatgtcttcatcaacacgctaacattttctctataagtgggcacacctttagatgtagatggaaccaaatggttaacattagtctcattagaaccattagaatcagcagatgtgtatgaattgggggcgttagaattcccatttcgcagcagcggtgagatttcacagttagtttcatcatcactgcatagaacttcaccatactcccttaatcttcgttccttcatctcaaccaattcctgtgtggtcacttcttgcaaaatctcagacccgttcaacactgaaattaaagttgccgttgcactgccactgggaaacggtaacttttccctcacaataacttgcttcctaatcggaactgcaaagaatatgccaaaaaatgctaacgctgccgaccacattagcaattcgttaaaagagaacgcttctcccatatgtcttgtaccaccactttcctcatcagttagaaacttttcaatcgctggaaccactccaacaaatccatacgctaacggtccagttccaactgcgactgcgatactttgcacataaacgttctcaacatcgctaaactgcgaatcattggggaaaaccaagggccacacttgcttgaaaacagcacaagctagaagagcactgggcaacgacatcatagaaacccaccctgtctgtaatccaaactgaaagttagacactagtacaagagaacctattatcaacccgattattgtggatcttagtgtcacttgcttcaaccagggtttacgatcccattccgttatgctcccacccctacttccaccagtctgactctccatgtataattaggtactcaattgcttgttaaaccgaagatcactaccactgctcacaacatacagatccactgttctcacaacgttactacatgcaagagcttcgggattgcaacttcacattatttttgcagcattcatttattacccaggattgcatccttttaaatgttgcagtttttcatgttgatgaggaatataaaggcaaaaaagtcgtagataaggcataattagtcagacagacgaagctggagataagtatgctatcgtaggatatttccgtccccaaaactgctccacttttaatggtcagtcttattttttcctatgtgttggtttatcacactatacagtgattgtataatattcttccaagaacgttcctctatatgcgtcgtatgtatgtatataagaatgtctgtcattattagtcgttactagtacattaaattcgtggagtttcctgcatatagattcaggcacatacggaaaaacacacggaaggtgcaaagactcgctaaccttaaagcttcttttttttccagttaccaaatgaatcatatcattatgattctgcgaatagtatgtattttaggatatcgcttagagtgagaacaccagttaggaatccgttcgaatcgacgacgaaaaatctatgtacacgagattttctcactgtatcaagaatggaggagagtttatcgttttcagtacatgtgaagacaccttcgaaatcatcacttcttctcatcagagcttccccaacggatagggaaagatcgttgtatatgcctcccttaatgagacctaggacatcaacggcttcgtagacgttgaccaatttaccttgctcatcgacaattggaacactggaaacgcctccagccagagttaaaagttgaatgacatctattactggcgtgctcatttgacaactcatgatgttatttgtcgatataatgtccaactcacgtagaggcctctttagatagcggatttccttgcagttcaatgccacaaattttaggatacggtattgtgttaacacactcacgacaatttctctttgagtctcttcatcttgatcaatcaaagggatcctcctggaccgggattctatcatcttcacacatgcttcatacaacggtctgaatggatgaattgatcttgtatcgtaaggctggatgccaatggccctttcaatatctttgagtccgttcaattgtagtttatccaccagttcaaacttatccgggttgtggaaataatattgaatcacattgatgaagtctgaacttgtcaataaacctgcaaatttggaagtttgagcatcccacaagggagcagaaacaacattgttttgtaacaggatatttaacgattttttcactagtaaagaagtgtccaacacaatcaatctatatgaaactggtaacacatcataagatgtcttagactgaaggaaaacacgtatagactggacagcaagtttctgttccagctcaatggtctgctgatctttcggttgaagtttatcactgcttgcaggcatctgtgtataaattgcttgtgtattcttgaataacagcttctcaaaacaatggaataggtacgtaagctgataaaatgaaagaagtaaagtttctaacaacacctcagtactttgaaaccaacacaatcagacagttatagatcagatttggccctccaactcataacaaactcgttgattctaatgctctaaggccattcatatcacagagccttacgtatcataaatatttcaatccaattatggggggagtaccataaatcacgttttacgaaacaagcaatggaaagtgaaaaaaattttagtataaaaggaacaaagtctgagattcattcacttctcactatgtattataagttcgcgaatcttttttgagttttgcttaaaaagccaaatctctttgcctattggcttagatcaagtgtagtatctgttcttttcagtgtaacaactgaaatgtcctcatagaggatattactgttacagactcagtttttggccaacattacaactaaaaaactaacgtttccgggcttgaagagggtttccagttgcttcgcgcgggagatagaatgaggattggagtggcacggaggatcttggcggggagagggtagacattaacgatagtcttcggattgtcgagcgtgttttcccctcatgtttccttccttttcccttccgaatcatttcactgttctcttctatttcttctggttaacctaggagtgtcgttaccattgcacttttgctgaggcttgaggaatcgtattccttccgcttcatgctccctcggtttctgacgcactttttctctgaaagcctggttttttctccttttattccttctaagtggatttgctcacatttcctggaaataagcttttagatgagttcatctgatctgcatagaaggacaagtgccatattatttgctgtcagagagattactttctcattactataattattattaaagaaagagtttatatcgaatgcattttttcctggaaaactacctaataatgtatgtgcctttggatggtgatctttgaggttcgtcattttcatgcgatttagtgtctaatttgtctgtgtacctatgagttctatcatccaagtatttccttttgcgtctttcttcgaagactcgatagaacttgagattctcatctcctccaacagatgctatagtggtgccatcaggggataattgcgatgaaacaatacgtgaatcatgcgcttgttgtatttccgcaactttgaattttgtctcgtaattgtatatggttatgcagttatttggtgtaccacctgtggctacaatttctgtatccatacaacccgaatgtttggagtaactttggccccagtgcaacgagctcacttgtgagcctgtatctatagttccgagcctattaccagtagttgtattccagaaatgtatatgcttgtctaatgaaccaccgccggtggctaatagattggtaatttccggatgccaactaatagccttgactgcggctttgtgatttcttttagtccatattggatcattattttgccttgtatcccatatcataactgtattatcattggcaccactggccaattgtataccgtcttccctaaagcttaacccacatacttcaccttgatgtctttcccaagtttgcactacatggtttttgattcgcacatcattgatttggatttcaccacttttgctaccagtaacacaaagggtatccaaccatgactgagaaccaatgcgtacaccaaggcctgacctcattgtcctcacatgtgtcatagtttcggcatcccatatttcgacgttaccgtcgtttttgccaatggaaatatgacagctatcatctgaccatgttaaactggtacatgtggctttcaactccaccaatagattaacatctccagactctccatcccagaggtaaatgctgttatctaatgcaattgccaagacgtttttcttggaccagcttagtaagttaagataaaaatcatcttgaaaacccggtgcatcaagaatcctttctggattggtgttgattttcctaagcttggctagggcgtttgtctttgaatcaaatttgtaagtttgcctactgccaattgagaaaattgggcgatccaaggaaggttgtggtgggagaggcatgtactgtaaaatcctttggttcatatccaacccacatgcatttgcaactttttgtttgaacattttctttgtctgcgcgctcaaatgtttaaagggtgaagcgtttggtggtggttttatttcttcaggatcttcttccagatcaatgcacttggtgttttgtgaatgatgcacttgcggtatgaaacgatcagggtttgtttcttggtcaattgaattataccctgtcccgcttaatggttcgtgaacaggcgattcttctctaaaaaatgaagaactcctccgcagtaaaggtggaattccatttttagcaatcagcttaggcctattgatagtatttgtcacgtttccaagcgtcgattttccctttctctttgtaatcttattctcattaggaataacatgtaactttgttggtgaagttaatgaaagcattgattgcttcgcagaaagctggctattcttgtccatttccccatacgattagggcacttctctcttttcgaattcttacctaacaacaataatatacttcgtctgagtttagtttgaaggatgtctaacaacgtagttgcttgttcaagtaaatccactgaatgccaattaagaagcataaaatactaatcaaatatatatggaaaggtattgaatcgaatatgacacttcctctgcccctaaaacgaatggatataggaatagtggtttgcttgaaatgtgggaactctcttttgaggttatgttctggttcaattagtgctttgtgacaatttttcgtcaacatatgttatacactgatttattgtttacattttgcctaatttggatacataagtgtcaatcgaaaagggcataaacatttgaaattaatgtcaaaagtaataacacccagtaagtgtgagtggactatgaggttgttaacagacttttatcatagatctggtctttgacaggttatattaagcaatggtatttaatacttgaattatgaatttcaaaggaaaatacaattttctttatttatatctaaaggatacagattatctagtattctgaaactcttgaaaactttgtcaacgacaaagcataattgtccttcaggatattgctgaagtagatattgaagtctactatatttaccagcctctacatggaatccagacatcagtaattatgccttcatcattcaccacaaaatagtgaccgaaacatgccatggtgatacatacgtgttgcattagtatttcaacttttgtaccgtgaggtatcattttgcaatcgtcatctagcggctgcaaaataccatgttcttgggagagtctttgtaaaaaccactgtccatactctgggtgttcaggcaacaaaccatagcccgggaatttgtgggaaacttcttttgtcattgataaaacaccagtgttcgttaacatttccccaattgaattgcctctctttgggtattgcgatatgacagtacctaaaacaaaagaggaaatattatgctctgtaatcgcacctgtagaaacctgttgcaagtcagaaatcattaagttacctgcatgcaattctagagtcccatgtaagttattaatgtattgggagagttcagaagtgttcgtagcatattggaaagaccttgcggtgggtgaagcaccaacactcaatatcaacttagaaactggatattcctcgtcaattgcaagaagtgtattgcaagcattattgacatggtcaatttcttctctcaacacagattcattagcctctgcagacgatttagaatatgaatgtcctgcatgagcgtaaaatccaaataattcaatggaatcagttgccttcagtaatctttctaaaagagcaattaagtcctcttctaggaaaaccccagctctgtgggttccacaatctatcttaacgaaaacagaccacttgaaatcgggatcacccaattccttagcgaacttttccaggaagtcaatatgttgaatgttatcaacaaagattctaaagtgatcaactttcttggagatttcgtataactgaggaataatgtcaggaacacacgcaggtaatccataagccatgtctgtaacgatcttagtcttctttttttcatggtaatccaataccaagtacgcctctctaagggtactcaccactatggaaccatatttggggccatcatattcaggaaggttatgacccaattgtttcaatgtgccctcgattgtcttatgagtcttgatatgagcacgatacttaacaggtctctccaaaaggctgttgatactatcaatggattgaagtaaagtgcttatattggaatcaattacaggttctttcataattaacgctggagttggtaactccttataatgcctccctttgtaggcatttcggatggattcctgtacacctgcaggatcgagtggatatctctcagatggactcaattgcgtagccattggcggtctctatcactggttggagcctttgatagattggacactctttgatagattggacactcatgcaaagaaatgtgacaggtgcaagatggtttctcattatatatacattaggtgcctggcttggcagccaaaaaaaattgagatgttttatctctcagatttctgaggggtagatatgagattacaaaattctggccacattaaatccaccttacgcttccttctcagccgcagttcattgtgtaactttctgctgcctgacaatacgaatacgaatgcgaagatgtgttatcaagcaagtgacaggaaacaatgatacatcctcttggctatcgaaagtcgacactggcttgcagtacataaacattcgccggtttttataagattattcttcgaacgataaaacgatgtgatgatcttaaaacgaaaatgacgtattctgtatcatttcccctcctctcgagcaagagaatatcacggaatggctaattcttatatattaggttgttggtgccgcagtaccatgtgcgatagcggatattccaaaatacccactagaaccaaaacccaagaagggtccagacgtttcttggtgcctttcgactttttgtttttgttttgccgttctggtctaggtacgaatgaaggaacatgaaaaacgactagtctcgtagtgaatcacgatgttcagaaaatcacataacggaatgatggtataaaatcgaagaacccgttagtacactcatggtggggaaaaccattaaacgaatagatcagcacggtaaatcctcgcattctttatctgatattaaatgtcttctactggtatgagcgtatgtcatgataagaatcttaaacggaaaacacccacataaacgaacagtgggattggaatcattgtcgcaataagaaatcaacatgaaacgcatccatcgcctaaaatagatagcatataatattcaagactaacagaaatagtatacgagttgcagacctacattccgaagatgaaaattttctagttgcggcttaaacggctatatccttttttttttttttttttttttgtgcgcttctcgaatcctttagtctttcggagcaacgatgattacacagcaggaagtaaaaaaagaaagagcctagaaatatgttgaatgtcatgacaaattacagacattactacggcactgcgcattgatgtgtccgagccattgtcattccaaatggacaaaaaaaaaaagactattgtctaatttttttttatgcgagattgtccatcttaaaagtttaaaaagaaaatcaacccaggtctcgagagcgaaacccaaacaccgagaattggaatgcaccaagaaataacaaacaaaaatgcacatatactgcccgatgtcaatttacttttttctctcactctttataacgaatacacatcatcataaatatatacggctgcctacatagcaatcatcctccatggcgtggtgattgctactgacggtaaagctatatttcctactacgaggaaaaccaaaaacaaaaagctgaaacaaaaaaaaagagacatatataaaacatatcgtagcaactgtaatactcacgagttcttgctttctgcgtgcgtttccgctttacctgccctgttctggctctagtgcattatttctacagtgcattcttaacgagaaaacaaatcgattattccttttacgacgatttcagtaggcgtatacttttttcattttttagttttcaaggtttttttttattttccagtttttcaatatttactaccggtgaagatttggataatcatttctgattaatcatttaaagaggtaaaagtgaagagcaagtgagacaagagcagaaacgttagtagttacttgtgagacagaacaccgaactatttttgagggttgatgcactgattgttattatttccactccaatttttcctttccctttattttattttttttttataattgattgggaagaaagttaacattaacccaaaatatcaagattactatcgttgcttaattctttttattatattattttcattattattcatatttcatcactatttcctttaccaaacttaaccaagaacttataaagaaacatacattacactataggtaattgggatcaaggctaacctttaagctattaaccgatagttttactttccttcttagtattctctttttgtctgtcttatttaagttgatggaagagtctatctttgatgtatccaattctggaaagaagaggaagacaagatattccagaaaaggatgtctgcagtgcaaacgttcgcatttgaaatgtgatgagggtcaaccgaaatgtgggaaatgcgtcaagagaaatatttcatgcacgtaccagttaagtcttgtatttcaagacgtatcacagtcgaaactgaaaagcatgcctgtcattcattcaattatggattctaatgatggtatgattaaggagataccatcccagccgataggtagtcaaccacgcaagaaatcttcgacttcttcgacttcttcttcacaatcacttacacatacactgcaaattcaaccacatccacaaccgcatccacaagtacgtccacaagtccatcaacaagttcatcaacaggcacatcaacaggcacatcaacaggcacatcaacaggcacattcacaggcacatccgctggcacaaccgcaaggacaaccgcagggacaaccacaaatacctacacaactgccattgctgctgccgcagctgtcacagcaacaacagccacaacatcaacaacaacaacaacaacaacaacaacaacaacaacaacagccaccacaacgacagcaggaacatttacaattgctgtctaatataccgcagcagcagcaacaacaacaacaactttcaacccagcaagcagattcattacactggaatgtgaaacctgattttgctcaactgctggatttgaacgactttaacttacaaaatctcatttgtgtctccccatcagacgccaaattactgagcttaccaaaccttaatgccaaacctaatacctcagccacagaattaaagaactgggtacctcttttaaaaccatacgatataaattggagaaactttgtctggatagatatgttacaacttttagagaaagaggatccattccaaactgcatacaaaagtgtaaatccaattgcgatcagcgaaatcagaatcgatgatcccaacctaactaacttcatttggagatttgcttgtacgactttgatcgcgggtaatttcttgttatttcctcatgatagattcgataccttcatgcggtgtctctggtctttgaatgagaaacatacaattgtccaagatgctatacgatatgacatctcagtttttatgcaggacgtgtatgaaaatgcaaagttgcatcatttctcccaaatatgggatcgttatgtaagagccttaagtttcaaacaagtgttgggaaccatcaatgaaagaatccaaaattctcaagactttgtggagtatgtttgcttaacattcaccgtgttcctcatgttttttgctaatagtgccttgagaagtaatctctggagaactcatcttagaggatgtcaacagcttttgatcagagcatcaatattgatgccaaagggtcaattgaccgatctagagcagaatgctgctgatatttacagtgttttaagggattggttctgtcatgcggaaacagccgcttcaatcgcatcgaattttggaatttctttaattgatatcactgaattcacaaagactgctttccttactgaaagctctccgttgtcgttaacaggcaattctttcaatctcttgaaaggtatgtccaataacctcaactctgtgtatttccacctcttgttgcgaatgttcgaatttaaagacaaaggcgtcgatatttccggattaaacattttccttttcaaagtcaacggaacgacaaaatcagttttacctcaattatctatgttcggtagagaattgctggatgaattacagcgttcagcagttttagattcgaatctagaattgaatctcatcgacgtgactgacctaaggttgaaattttcaatgcttgcatcgcatagcatgttttactttctaatggaagtctatctcaaggtgtactttcttgatgttgatccaaaatctcctgagatcaaaagtattctatacacaatggtgaaaacttcttatagcaacccttattactcatcttgtggggtgtgctgccatccatcgttgttcgtaggagcactcacatgtattatagctgaagatgatgtgctttatgtccatttcatcgaccttttgagtaaaatcaccgacagcggaatggcagttgctaaaaatagtgtagacaagctaaacgccatcaaagctaatgttgcaattggtgcttatcagaatatcatcaatcctgatcatgactttatccccatctaagttaatattccctttcaatgtccaaaaaaataacgaagtcaatcactttaaatgaatcctctaaactggaacaaatatcatgccaaagttgtactatttcaattataatatagaagaatatagattttcaatcagttacttatttatcttgatgtgtgagaatatatatatatatctcccatccaaaattcattcaattaagaaacagcttttttagcgcacagattcaagttttttacggaatttttctgttattgttttgagtttaaggttcagtttagggaaaaaatgctcttcaagtcgttattaattcggaattaaaatacaaaaatggcgtatcctgcatatttaaacaaaacatagaacggtcgatgcagcgctcaaaaatgtaacaaaggagaaaacagcagagagtatgtcgtgccacaaattttttacggaatgctaactagagattaaatggtgatagtattcctagatttacttatgttgaccgtcaaaaacctcaattaactaaaggaaagctcgttttttgctttaaataggaaatgttttccacggaagtctaaaaaagttgtagtattctttaataaatttcaaaaagatgaggaagatcatgatcttcgagattttgtttgttgccttctcgataccatcaaagaacagtattagaggtgaacacctgaaagctcagaagccacgtaatagtcaaaacatcataattcagaaactaaggaggttgaatatcaagtttgatagattgaattcactttcaaatctccagaaattgaccgccaatgactatatgtttctttattcgatgccttcaggaatgagtcggtattcattgaggcagtgtcgcaactctggtcacgttttttctacaacaatcaggtaccaattttgtgaaaaaaaactgaaactttatgcatttaggcagtagacatggtaagttaatgaaatatgagatgagatcagtttatagagaatgagggagctatgaaaaagaacttaagctatataaccattggtatctcaaccgtttcagcgtactctgctcggtagatattattttgagagattctaaatatcaggccaagcaatcgggttaccatcatgtctgcgaaagctgcaggaaaagttgagaatggcgtaattaaacatacgaaagagagtgaagctgacaagagaaaaaatgctggacatagttataggaggaagagagggagacggtcaaaggcagaaaaatcagtacctgcagagaaggcaaccagtcttgaaattaccgccaaatcatcccataatgaaaatgcagagaaaaaattcaaattgagaaatgccttgaagttgcaaagaaaagccgaaattgaccaattgtgccatttggctgggtcagatattgtaatgttaaggaaaggacaatatgtcacgacctactcgctaacgtttattaccactgatcaagatcagaatcaaaagaaagtgaaatgtgttttcaacattccggtcgattatcctcaatccgccataaagctaagtaaaccgaaagactgttcttcagatgacccgttatcacgaattgtaaacaatttcaattataaatcaaaagctttactcaaagataaacagccgctagttatacaattaaactatttggttaccaactggaattctttgcagtctccggagtatataaatagggacacggtacagaagaatctgatgtcaaaactctctgattgaaaaaaaaacacagtagcgaataatatgagttactcatcatattcatcgaaatggtcattacagaagagggaaactacattatacacacgttaatattcactcactccttgacgaagactgcagcagctcccataccagtaccgatacacatgctaacaacaccaatttgaccagcgtctaattcccttaatatggtagcgacttgtctggcaccagtgcagcccaaaggatgacctaaggcaatcgcgcctccccttgggttcaatttcttcttgtcgatttttagatggttgacacagaaaatggcctgccctgcaaaggcctcattaatctcgtaaacatcaacatcgttgacatttaaaccacagtctttgaggactcttggaatcgcatatgctgggccaacacccatgatctcaggtggaacacctactgcctggaacgcaacgtacttaccaacgatttccaaacccaatttcatggccatggatcttctcattagcaacacaccagcaacaccatctgatatctgagaagcgttaccggcagttgtcacacctgtttccttcacaaatgcaggtttaatcttttgtaacgattcgaaagtgacgccctttctaggaccttcgtcctgcgcaattatagatccgtctggtagttcaatagggatgatttcatctttaaacaatccctgtgagacagccctttccgctttatagaatgactccagggcaaatttgtcctggtcttctcttgaaatttggaacttcttagcaacgttttcattagtaaatcccattggtatcatacacttagcagcagccgtgttcgatttcaactcatttgatatagacccaagagccttcggaccatagttcttagacatagattccaccccgatagccaaccctacattgatctgcccagaaatgatcttatttgcaacgtcgttaacggcagttaaccctgaggaacactgtctgttaatagccactaacggagtttgatatggcaaaccagcagctaacatcgcagctctatgttctgtcgcacctgcaccgggattcaacacattaccacacgcaatttcttcaatgacactcttatcaatgtcaactttctcaaaaaattccttcagaaactgtgtaagtaaataatccgtgttaacatctttgaatcctcctttgaaccctttaccaatagctgaacgatacgcagctacaacaaccacatcgtccggattcttactctttatatccttttcagaactgcgtcctgtcaaatgtttctctaattgttgaagtctgctagccatattatatttctgattgactgtactcgcctgtagtatacttatatcttgccctatgatgttcacttgtcaatcaattcatctgataaaagtcagtgataaaggaataatgtcagcatgacacatttatgtacgtaatttatacaaaaaattatttgtcaaagggatcactcgctaaaataaatatggggaataacgaacaatgagcagaaccaaccagccgtcgttttggagtatgttaaagaggatttaatgatcgcatacatcccttcttcacggccattaagctcgcagttaatcatcaacactgaaaagcagaaactttacggagctccacgatgtcattaacaatgatcctgacttaatctaactacagtctcaaatttgcctttgctcaaggctatgtcgtagaattggagatcggcattgtcacactaattccggttttcgttatgaaataccctaaaaatgaaagaccaacgtcgcatgcggggtaacccccaagttgaaaaaacttaccccgggtagcaaagaagatccaactcacgtgactagtatctatagattgtttcacgtgtcgcgtactgtttccttctggtctcttcttcctttccaaagtgcgtttctgagcttttgatcctgtttttgtttacgttttttaatttttgatccatctattaaggaacgtaacaaaatgaagcactaaaagcgtatgaaatttagtacacatgttttgtaacacaaaggaaatccataaatacgtacacttgaagagagtctaaaactgttctacaatcagctttgctaatcattagaattaatcgttttctttgacaaattgttttttgtacaagcgtttatctagtgaaattatttcgctatctcccagatcattattgaatgatcgcgttttccttgtattgatgagtatcaaatcacttttctggctataattctgcaactgaaaatcaacaaactttgaccgaccaatgactgttgataagaatgaaaaatccattagtattttgtttccgcttcgatctggatccattaatgctccgactgcaaatgccaagaccaggttttctagcaatgattccaacgatgatctggtaatacaagggctgaatctagtaggaacagggctcaaacctcgctcccagaccctgcgatacatgaaatcacacaacttttcaactccgaacgttgattctacgcgacatgtttctaaaacggataaaatgtgtttagcagacactcagctaccgtcagaacaagaaattgatgccaagtttgaagagttattgaatggacatgcgtttctaggtactgctaagcaaaatttgaaaagcttgtcgtatacccgtaaatgggaattgattcagaaggaaaagaaactacatggtgatataacgatgcaagacgattcaaaattgaatactttacatatgattttgagcaatttgaataagagattctcggttactcaaacactttatcaattggaacgtttacttcgacatgctgattttatttcgctgtttgtgaatgcaaacggagtttcgattttgaatgggttcattgatttattggataaaaaatcccagtacgtgtacttatgctgttataaagcattgcttaacgatacttcagcaagatctgtgatattccagaataatgattggataacttacgtcttctgccttttaggaacgctcacaactgaccttagagttcgtcttttatctacccaaattgtgatccttctgacatattccactgaatggtcagattctttgttggaatcgttagatttgtgctacgaaagttggatccaggcagtagaaatgactcttcgaaacccggaggattatgcgtttaacaactctttaattcttccaaaaccaaaagaattgctcgtagattactctatatctacattgttactggttcaatccattcaacaacttctgccttccaatgatctaaaactggcgtgtttcaaaagatggaagagagctggaatacaccgggttttccggctaatgaaggatttagactcatcagctttgaatcaggacatagacctgtatatcgaacttgaattgaaggtgcaagacaaacagttcaaaaatgagtttctgagtgaaatatcttatggtcctcaaatcaagagtttaatcgaatatactaaagatacgccgttagaaacgcctatttgcaatattatagaaacgatcttggagctagtaaatgaaagaacaacggaaggttcaataaaactgttctatgttttcaattctattctaacctatctatgcgaacataccttggatggtagctttgatgaaaccaacacggaacaagttttcatgacctcactagatcatataatggataacttacaatcccatcaaattgccaaaagagcaatgatggaactggatgaaaagaagaaagaatttgatggaatacaacttcaattggatacattgctacaagacaaacaggtttccaaaggggatctactgcagaaattagaaaataaagaagaacttttgaaatcaagggaaataagaatagaagaattgcaagacagattggaagttgtagaaaatcagctaaagaaagaaaagaaacagttggatctcactatcgcccatagagatgtagcagaatatacaccaaaacgttctgtgtcactgtttgagactttaaaagaacataaaccgcttattggtactcaacgatcaacttccttatcaaaaagtaaacgtatagcatcgctatccactgttgcaaatgaaaaacctcagtcaaaatatccgcactctaccccttataacatcttgaataacaattctgacgatgaccttccagtgactccgatatatccacgcaagaacgacatattccatcaggtatcagcactcccaaaactatcttccagtaatgatgtagtatcagcaacgaccacagaagttccatcagcccaaacagcatttgtgattcctgcttctattgcagcaccagcggctccgccgcctccaccaccacctttaccgcctcaactgaaaagtatagaagccttcacctcaccaatgaccaatggaccggccctagtaactagttctgcttcctgtgcttcgtcaaatgtcgcgcctccacctccgcctccacctccgcctccaccattaccatcaactctgtcatccctgaacaaggaatccacagtagaagatacatctttatcagttgcattcccaaacgaaaccctcccaggaaaaccaacagacggcattcctcctcctccaccgcctcctcctcctcctccaccattacctctagctaacaatgtgacattcgtgtctaagcctaaaccagaggtaaaaccgttgaagcagattcattgggacaagatagaggatattagtgacacactttggaatgaaccaacaactaggagtgacttaaaggaggacttaaatgaaaagggtgtctttaatgagattgtgaacttgtttgaacagaaggcagttcgaatgaagaagaaatccaacgttacagctagtaagaagaacgaaaaagtttctcttttgtcaagggatctggctcaacaatttggaatcaacctacatatgttttcttcatattctgttgaagaccttttgataaaagtactaaggtgtgacgatgatataatcaagaatcatagcgttcttgagttctttaacaaggatgacttcgaaactatcccccaaagtataattagatctttcgaaccctatgcgtcagattggaaaaccggtaaggctccgaaggaagacgtcagtaaattggaaagagctgatagaatatacctcgaaatgttttacaacatgagatattactggaaaatcagaagctcctctctcttgatcgctctgacatatgaaaaggactattatgacatcttgtaccaattacagaagatcgatgatgggacctcaatgatcaaaaactcgaatagactcaaacaatttttctacattgtcgtagagatcggaaactttatgaacaacaagaaaacgcagggtatcaaactttcctcattgaacaaactctccatggtaaagacaaacagtgataagaatttatcctttttgcatgtgatagaaagaatcatcagagaaaaatatcccgacatatacgattttacaagagatttgaataggttatctgacctggggaagattaacattgaatcgatagaaagtgagatacacgaatattacgaaaaaataatgagaatgaaggagtcattcgaacgtggaaaactctcgcatactgagaaacaccatccagatgacaaatttagaaagaaaatcagcgccaagcttcccagtgccgtcagaaaagcagaactgttacataatcaatgtaaactgactatgaatgatttcaacagcactatgaagtactgcggtgaggatccaacaaattccgaagccaaaaacacgttcttcagaaacttctctgaattcctaacgcttttcaataaaatatcacaagagaacaaggaacgagaagcaatgaatcgcgtacatgaacaaagacaacagttattacagaaggcttcgacagaaacccaagttgaaaaatctgccgatgacgaagctgcagatacgatagatatactgatcaaaaaactgcgtagcgttgaccctcaacagacaatccctggttcatccgttcccggaacatcatctcatccagaaaaacgttctacgccaagaaccaacagagatcaaaatctattatcacgagccatgacacttaagagcggcattcaaaacctgtgaacaacctctctcctctagccctcagtcacatacaaacttttcccgatccaggaaacccaagtacaatacatatgaacagtttaaacgtatatatatatatatatatatatagaccaacgccggaacaatattactcgaaaagtttcacataacttttccccacgaaacggaaaaataaagccctttaacgtcggaagcccaaaatttcgtgaattgtccaacctttcagcatagccaaactgacagtactccgatattcatgcaaatctcatctacaaaccggtctctgcttctctcttcgtaaccatacacagtctagatctaaaaacctagatctaaaaacctagatatattacatcagcatttgatacctaaacccacaaaaataacaatcctgccgcaactatatcgccaagccacaagccgagaaaagatgtaatcctaatataacagggtaacgcaagatatttgtactgtatccttacttaacgctacacactccttgtaaaccatcccatctcagttctcaggtcttacctatctctatgtccaccggctaatagcaagatctgcatgttctgatcggcttctatatttccgttttctcaacgtttacgactcgagcaaatacagcttctgctagtcagaaacatcaacacaacttcccgtctggaagcattctttttttttcgaaaaaatctaggtttaagagagatttatatatttatatatttatgtataagtgcagatacagttacaacggatctggagatctataagtatttagcagctaagtggtttggcagaacagagtatccacctagcataaaattaagaaggttagaagtagttcccggttatacactggatctgtttgtgctttggtttttttttggtctgattgtttgttacttggtgatataaggcaaagcgtggtttgagacctgtcttgcgatatttgtgaactgatcttcgaacagtgttataagtattcctttctacgtcgcgagttttgctagttttgacgaattcgtaagtactgtgtatcatgagtgataatactgttggcgtggccgttggttgtgctgtaggaatacccatcggagtggggattatagttgcgtttgggttttggtatcgaatgcagaggagattcaaggaagaagagctggaacacgacgggcattcaaattttgatgaagagatgagtttcaacgatatgggtgtgatgaagatgcagcaggctggtgagcatgttcaggagaatgagcacgaagttcatgggaatcacgtttcgtccgatgaaacggcatcgtccagtgaggagaagagggaaagggaagtggatcatactagtactcagctaaagaataactcgtctaccgggtccatcagtaggggtaaatcggggaaaaggaatatatatacgcctgcatatcgtaaacggttgcaggaaacggtttcctcaatacagaaacccatggattttgattcgagcaataacacgaaaagtacttctacttcgatcacgtctgcagatactccaaagagacagagtagtcagatcaacatgttcgataagatgataccgatgctgcccgatgctgcagttggtggaaatggatcaggatccatttttgacgagggatctgtgcccaggagaaattcatcgaatgaaactctactaaaaacgatcggaacactcgatttgggtgcatatccaaggcgaggttcgtcagtacaaatttccggtatgaataataataatgccatcaacaatcataatattaataacgctgataactctatcatttcgtcgagacattcgttaacatcgctgcatacacacatgtcttctccaagtacgaattcaaaacctataatagagaatgtattcgacacgccgaaaggttctaaagtgttgaccttaccagcggaaaacgattcatctgaacaatataggctacagaataattacgatatcagagatgatcatcacattgctgaagaagatcagtacgaaaatgagttcacgaactactcggagaataaaagggaatttatcgattctttgagaccaaaaagacaaacataaggcaaccgtaaaatggtactatctgtcactccatggaggaaatccattcatctcctggctgagagaaattcacatactcgaaaaaaaaaaatctcattaaccattgtttgccaaccggtagactcataccatattggagctgctattactatcatcattgttattattattattactattttaatctgtgtatttaatatttacaagatataacgaaaggaaaagtacacagttagcttacaagggagaataagggctaatgcattatgataaaatgatacataaataatgaattctcagttgaaaaatacacttttataaagttttagcaccaccgctttcctctaatagatcgtatttcttgtcatcaaccttgacactccattcgtggatgaaaaattcttggtgttggttctctctgtctgcaactaatcgaacttcaccgaccttacccttggaacccttcaagtaaaacttgatattgacattaccagcaacttgattaagctccccagagacccatggaacgagcccatcgaaatctatctgatcaccaagaacttctctaatcttaggcgaacgacgcatatggtatagggtattggaaataaccggagactgtgtcttctcatagttaaaaatcatagccaatgctgaggtcattagaacaatgaacccaacaaactggagtcttctcttgttgacatctttagttgggtctggtagctctctatcgattctcattggtctaaacttgtcttttaatataatctctggttcttgagaggccaaaaacctccttgtaagtattctgctcacagaaattccggatcttggtgcaaggatgcgtctaaacattgttaatatggagtttctagcctgtgctggtgttggcggattgtgtagcaatgtcccttccctgtttcctaatcatcgtatgttgtactggccagcttcttcgactaaatttttcaaatactcggatcttcttataatatcatttcatagtagaaatcaaacaatgaatcgagaaaaaggtatgaaacttgagtcaaatcagcaaacaggaaatcatctgtggccaaaagaatatacaaagacgaggtgtcttcaaataaaccacgtttattccctaaaatgacctttgtatgttatgctatgaagcctagtttgggttgtcaatcgtattgctacgattatatgtctaaaagatactaacatctatgctatgaaatgcgctcattccttccgaagaggaagaaggaaagagtgtgaattggatgagcaagactaatttaagatcggtaaaactgtacatttggctattgatgctgttttaatttctacctgcttggcaggtattaagagaaatactggattgacccctaagattgatcacattagcgatattaccgttagggaatattccacgaaatatttgaacttgggagagtcagtatatgattatacagtggcaactctaggatcttcatcatatttccagaggaaatgagatacaaaagacgaagttcccctttaataacttaatttgttttttttgtgtgatcttttcgctataacgggttagctatgaatgaaacagatgtgattgtaagtccttaacatatatttatagttagtatattcattatatatttaagtggttttgaaaattaaagttcggtgtaatgatacattgctggtttcagcttggattgatggcgaattcagctacaacttcttcggttgattgcttgtcgtccatttgcttctgctcgcaaaatttaaagatggcatcgtagccagttggtgtatcagcagcattttctgtattttgaaagagatcatttatgtgtgaaatactaggagacttccgttctgagctttttccatcactgccaatgttacctcccagtgagcgtagattctcccagaaatcattaccatcttcttccataattgatattgaggacacggtgcttggggttactttattcttgggtccattgcgatcaaaatcttcagctggtgtatttcctgtcgatcctgcagcactagagtttctggattcatttttacctcttctctttgtttgtttcctcttatgtccatgaagtccattcggacttggatttaacaatcggcttaattcaactgtcttggcgttttcactggatccaagctgtggcttgaccgtgggtggtaaataattgaaatgtgagtgcctacttggccctatttctctgatttctggagctgtaggcgatggataagatgcagtggaacttgtaggatttggtggcaactggcttaagccgttttgtgcataattagccccgttcattaaatgctgttgttttatgttctgctcttgagcttcatctagcgaatcatgatgatgatggtgatgatgatgataaaatcgttgtagtttatcgttgagagccgatggactttgagtttcatcgtccaatccccaattgttgaagtttggagttttggatagaaaatcagtttcgaagtcagagaaggacgggcttctaatttttggaagatcttgtgaatttgaagtagtattaccaatgtgtttattttgttgttgctgtggtaacattaacggaggtggagatatttgtctgggagccagataatggttgtgaatatgctggtgaattgatattttcaaatcattggccttggcatgatttattaactgttttaccaagtcagcgtttgatataacaccgttggataaggtatgacctgaagattccttcagactaaatttccagtcaactgttgtttctggttgttgtttcctagtttcgacattgggtattggaagaaatgtgctaggtgatggtaatgcagattcttttttgttgatgctgccaacaaaaatagaaggatgtggagagttgtaatgcggtgaaggcgatattatgctatttaaaacagctggatctggggtggctgtcgatctttcgttagattggtgtggttgttgtccatcattcgcattgatttttccagttttcaagacatccaacaatgccgcactagaattagttctgttagtcatgtcaaatatcataggtgtcgattcttctctctttacagtaccactcgggctcttcattgaaggttgtggcgtatttgaagttgacataggacgtgaaacatcttcgtcatcatcagtcttgttttccttttcgttttcttcacctaatctggtcatctcgttacctgcatccatgtttccagcttgtacagcgctttttatggtttcagatgcaacgcctctaacaaccatagtgataattttcctccaacgatttctacaggttaaacttggcctagcatccatttccgtcgatatttgcctccatttcgtaccatatttcttgaccttcgctataagtagaagatcttccgtctcatcccaaggtcgtagtcggtctttagtactgggatcaagcacttcgatgtacctcttcgcgcattggtcttcagttctattctctaaaacgtaggaaatcttaaaccattgcggaccatggtgttcatatgattttaagagaagctcatcctcctctggtgtccatttacctttcttcaatacaggatctaaagaactagtccatctctttttcacatccgtcgctttcttattatccaattcgaattgcttggcaagctgatcccagggaatttttttgacaacattactagattgctgaattgttttaatagatttgataccatccggatatcccaaatttactaacgattcgttaaccaattttctaagcagatcatcttcttctttggtccatattttcctcatctttcttctaaacgtttgataccctaaagattctgaaacctcaagagcattgactggttccttcttaactctcttcctcaaattgctcatatgctcctctgacatatcacccgaatcgtcactcacactgctagctacagttcctttctcactcgacgattcattcatattccagtcaaaatagatacttgatccaagatactgatttcttgatagaaaagtcaaaaaattagactgaaatcaagtttattaattaacaccaattttactacttctcaaccaatgtttttgagattgttcaaaactttatagcaagtgtatctcgatatttccgttatgactgttagtacaatcaatagatgacgataacgataaacttctttttgtttctgttaatgatattttgggttgaaaaccaagttgtaatttaatacagctctgaaactgtctacacagccttgtatctgctgtgatataggcgctgtattcaccgttttcacttcgcttgatagataccctgagagatactctacatagttatgatgtcaaatttgagtaatcttagtctggcaaatttctttattttctttttcaggcagaagggccctggcagaaattttgtgcacgtgatagtatccgggtaatgtttaaataagtatacatttctcaacatggattgcatctctgtcgaaaagctgctttcaattatcaacaataataacttcaggaacgaagaaacgaggtaatatatggtaacttacaggctacatggcagctgaaatactagttttgagtgttagtttaattattgtaaccgaatcatttgttaaattctaactttcaccacttatatgaaactggcgtagaaataatgacggtatcgtatcatcgaaaagggtttgatgacattagtgattattccagatcaacggtgataactgcagatgtctcttctaaaccatactatttcgaccggaaaggtatcaaagatagtttaaattctggtaatgaagcacgtgatagaggtagcgaaagtaggtggaaatcgttgggatataatactgtcctttcaactctttttgattcagcaaagacatggttttcctggattgatcctttggagcaagaaaatgggaaagatcgtaccatttccaacactactggagcaaattacgacagtttgaaaagaggagttgatgaggagtcgactccgagaaagaaaattcatttagactcactgctccaagagaaggagcatttaagggaacagttacaacattcaattactccaacgaaagaagtgttgaagttacctaaggatcctttccattgggataatactaatgaagaaaactatacagaatcctcacctacaagagtacaatatggaactagactctatagaaaactcaagcataagaaccagcaacagcagtccactgcattaattgctaaaccgtccgatgaagtatcatatttaaaaaatttattcaacggagaatatcatgtaccgattgagatgcaaaaggaaagggaaaatcagctcaaacttctttcaagagataacagccacagcagcaatgccagtacaaacagtagtaataacaacattgtaaggcttacagaaaggattaaggctttaattttggaaaacaggaaatcaataggcccaagtaccgaaagaggatctacaactgatgacatagtcataataagagagcacaagcttgatccattagaagagaaaaggaaacagatctacaatcagacgttgaaatttgatcgttctctccttacttttgaagaagagttcaaaagctattctcagttgattgaagaaagaaggaaactagtagagcaagtgaggaaaaccgccaaaccacaaaaactgatacctgatctatcaactgaagatttatcggaagtgaaagcaactttcaataggtctgataacgctgttctttcatccaagtatatgttggaagtaactgtgcgagatttcaagacattagcccctagaaggtggttgaatgacacaatcattgagtttttcatgaagtatatcgaacaaaacactgccaaaactgttgcatttaactcatttttttattctactttagctgacagaggctatcaaggtgtaagaagatggatgaaaagaaagaaggttgatattttagatcttaataagatcttcgttcctatcaatttgaatgattctcattggacattgggtataatagaaatgaagcaacacaaaatttattatcttgattctctttcttctggaatgaattcggtcagtttcctaattatgaaaaatctccagtcttatgtgatggaagaaagcaaacaaaagcttggtgaggatttcgaactttgccatattgcttgtccacagcagccaaacggatttgactgcggcatatatgtttgtctgaatacactttatatgagcaaggattacactttgagctttgattctaaagatgcagcaaacatgagaaattacataggtcatttaatattaagtaaatagaattaaactcttttcgttgacgaatactaaaatttgctattcttaccacttgtttcagactatttcaaacgttgaaatgaaatcatcttgtagacttcgcaactcttcaatgtcaattgttttttcatgattacaaaacgctttgagtttttgtactaaataataaacctgtttgatttgggtagtttgacatgcattatcacaagaatcttcctttgcaatgattttcaaaccttttcttttgctagctcgaagtaattccgatattttgtatgcttccaacataattctttcactgaaaattcgtttacaaatcatcataccgtatccttctatctcttctgattctgtggaggctttatatttcattttgagatgtgattcctgatcaatctcagttttcatctcaagatgtaaaacacgaggctttggtgccaatattttaggaatatctctgaaatgtgtcgatagaaatacagtagcatttttggaaaggagatattccgatatagccaaagctatagagaacccatctgcgatgcttgagccacgtcctaattcatctaggatcataagagtcttatctgttatatcatcaatgaaatatgccatgtctttcatttctgctgagaaagtggatgaatacgcctctatgtcatcattacagacacgggcatgaagcttctgatatagggggaaagatgcagaagtacagggcacagggcatcctatctgcgccaaaattgtaagcatagcaacttgtttcaagtatattgattttccgctcatgttacaacctgttactatctgaaacgaagagagattgggtattgcctctacatcattcgctacaaagttggttagtgtattttctaaaattggatggcgagctccactaagtgataaatgattaccaaacgatgctaaaatccagttattctctaaacccgttgttgcaagagaacacaaaaggtctagaactgatatagcctcagatatcataaaaagtgttgcgatatgagaagaaatattggataaaagttcactcacggtttgttcactcaaagctatcatctcacaagtaagctcagagagccttgtattcattttcattaagttcaatgtggtaaattcatacgcagttttcttcgtaacacgattgataaagcaggagtctaaatcagagagctggttaatgtctttcttttttagtttcaagtaaaactgccgattaacatcatgtccatggctgaaattcaatccaaatttatctctgagggagtccacttctctcataatatcatctgttaaagatttatacaattgcctgagcacgtcaagaagaccgtttgaacctctcttaatagcgtacgctttctggttttgtagatcgataggtgtagaagcccaacgtgtatcttcattgagatatcgattgatcaaatcaaagatgctgctaatatcatctgaactaaatattgccatgatttctgacaacaatttgctttcaaatttgctttcttcgaaaagtctcttaagcgttgttgcactctcaatggattctttcaacaatatgacataattgagcttttgatcaggaagaatgacggtgtgattgaacgagagaagtttagagaaaagagcatccaggtcatgaagaacttttagctccatcctaaaggaatttaaaaaatctgggttgttctgtagttcctgtacagcagaaactctaagctttaacgaattaatatcagttaaaggttgaagtatatcattcctaagcgctctatgtcccattttagtcactgttttgtcaattacttttaatagtgtcattccatttgattctagagtgttttctattaattctaaagattgaactgttttcatatcaatcaacatggtattgtcaccattatcaattctaactctgaagttgctaaactttaaagctaaatcagcttcagctatttgtgtcatgtagttgctagccgcagatactgccataagacaaaactctttaccgattaattgttccgcgaaaggtacaggagacttgtttgtaccaagtaaggcgaacttttcaagaacttctaatccctcttgaggattgtaaactttcgtggccgcctcgcatatctttacattgtcggaaatattgcatttgactatagtcgacaactttgaaacttttcccgacaatgaatgcgatggaatgaggatttcagtgggttgacagacgtatattttgtttaaagttttaataaagacttgagtatcaatgaattctgaaacgtgcatttccgcagttgaataatttaccacgcaaattccaactcgtgtatctgcatttttcccagactcgaatatgctaaatattgtcctgtcaggccctacaacaagtccagaggtagttgtagtaatctttttatttcttgacgtataccttgactcagatttggattgcctagtttgcattgattttctgattggcaaagaacaatccctttcctgctgatgatttgataattcaaaaatagttggctgcctatcgactttacgtttcttagatgttgagtgcctgctaacccttgaattattttgagattgattatccgatgtagtggttccgacggaagaagtgccttcgaccgaagacgattcaaaagcccactttgcgaaagatgtaacattaccagatgttgtcgctgtgttgttcattctttaatggttagattatttagctcaagtgctatttcctccgtgacctctttcaatacctcttcctctttcgtgttgatcttctcctgttgttcaggttcaggtttatttatatgaacctttgttttcgttttcgattccggcttaaattgtttgccgctgaggttttccaaatcttcgagccagcacaactcttgggcaagcaaaaaggctgcataatctgcagagcccttgaatatcagatcagtatcttggcgtgaggtcttgaaatcaccaactatctcacggttcagtagcaccctaagccacgaattcggtgcctccatgggtaacgatgcaaacgggtacacagttaaggacgtaccacagacaatacaaactgttttttccttcgtagagctatccaaatcccacgtatcgaagaactcggtaggtaacccttcaccgaagaatacaatcttcggtttaatcaacccgccacatccatcacaagtagcataatttccgccgtcctcatcggtttcttgttcgtttaatagtaatttattttgaaaagcttcctttgggaattctttaccacagtcaatgcaatggtttgacgcaaatgatccgtgtgcttctataatgaattcatcgctgatatttgcttctctttccaaagtatctatattctgggtatatattctttttaaccggtttttgctctcgaatagtttcatcaaataatggaacggagacggcttgaaattaccaggatacaactcctttgcaagagtataaaacggtttgggattctgttcgaagtattctatatcgaatacagcttcagcataaggaagattcagttttgataagttatggtaaagccctgtttctggagatctgaaatcgggaattccactagaagttgatattccagccccaaccatgaatataactttcacatcaggattatcctggaggtatttggctaactttttaatagccttcggtatttcagcagacatagggatgggcaatatggcaccgcgaaacgaaagctggatctataaaaatcgaaccaaaaaaaacactaaaaaagaggttcaagtagtaattactgaggtagtataccctagtaggtttgtatgaccagatatacgacgatatgtgggaggttcaccttatgaagctgattaatagatgaatatccggtatatagtatggataaagaatataattaacttaccttccttttcatggtggagcagagtgaaaaaaaaatcaaaaaagaaaacgaccccggagaggattgaactctcgatcttgcgattaacagtcgcacgccttaaccagcttggccacggagtcacgtttctggtgtttccgatttcctgtccaaccatactcgggtaacaaccggcttcaccatggtattactcataattccactttcatgccatcctgttgcaagcaggccacattcttcttaggctgtttcaatgcaaccacaacaaaacaatacacacattactaataccttctatttaacacttgaatggctgcctctcttaatacagccatctctatctattctcacgaacttgcggtcttttggtgggcattttttcctctttcgccccgatagcattctcaacccaagaattcccaggaattccctgggaatcccgagcattagcgtgacttaccgcgatagtgaacggccatattcttgtagcaaaggttatgtagccctactacaagtacatgtgaggtatgggttctgctatctatcctattcccgatgccctcttcgaaactgcccatgtcattagagtattctttctcacgctcaatgaagtatcgattcatcctacaaagcaccatagtataccatcttaggttatgtgtcattttcactagtagaatctgatttggagaaaagggaaggtggaaattggaaaactgaatagagacgttttggctgcctgttctaagttttggctatataactttggagtcaataaggtgaagttgtgaagctgttaagttaggacgtttcaaatgctgaaggactcagttatctcagcgtatggtattacatctttcccaatagcaagcttaatgatacctgtagctgtcaagagaatcaaagacgtcggtttatagcaggatatattattagagtgtgttgaagaatgagtttttctacgggctcttcttcgaagagtacctcatcggtagtggttgttgatgttccaaagccattcattcaggaagatgatcacacgaacagcgagaatgtagtaccatttgatcagtctgtgatagagtgtcgagatgctaacaatgaggaacaggaagctggtgggttcatttcaagagtttctactaaattggagaattatcacaaagagtccgttctattgaatcaggaaaatatagaacttccagtctacgataacgacttatttgatcctttgtccagagctgctacacaggatgttgtttctaggcgaaatacctgtcgtaaggattctgtagagggaagtataccagaaattgaagatgatgggttatacaatgcggatgatattatagatcctccgccagatggtggatatggatggatttgctgtgcatgtgttgtggtaatgaatttctgtacatggggacctaatacgtgttatggtgtgtttctatcgtactatttgtcttcgaattattttcccaatgcaactccgaccgattttgcagtcatcggaggtttgatgcttgggttgactttgttccttttgccattgtctgccatgtgtatgaacaaattcggttacagacctgttatgttagtcggcgtattactacagttcacatcgttcatatcttcttctttcgttacgaccattggggagctttatttcacgtatggtattctattgggttttgcgaatgggtttatatttggttgtaactcagtggttattccaggttggtttttgaagaaaagagcgtttgcaaacggtcttacccatattggagttggattaggtgggttagtcttaacgtttgctgtgcatgctattatggagaaaacgggatctcacaaatggccaatgagatttttggggatcatggtcttggtattcaatactatcgcagctctgattgttaaaatcagagtcccacgtaaccctccaccacagaaatcttctctgcaattgttgaaagatgtctatgatttcaatgtttacaaattaactcccttgcagtattgtacgctatggtccactatgaccaatattggatacgttatcctactattttcattatcaaactatgcattgtccatcggattgaattctcagcaggctactgtgacgttagcactatttaacggggcacagatcattggacggccagctatgggatatttctctgaaaaaattggtcgtgtcaattgtacatcgatctgtatgttttacacaatccttcttttaggcccatattggttcaacgtcgatagctattcagccatactcggcttcacatttttattaggtttggcagcaggtgtttcatccgttaatgtcatcccattgattgccgatgttactggtatggctcatttcccagctggattaggttacaataacatttggaatgggtccactgcagtggtagcagaaatttttgcattaaaattgagagattattcgttaccacaaccatacctccattgtcagatatttgtcttagtcatgtactttgtgggtctgttggcattaatcccttatcgcgagtggaaggtaagaagaatgttgaatgcacggatatccggtaagaacgtcgatgataagattcgattgaagtggcatagagtactagagcccggtgtattgaactatttcaaacgtgcattttatctagtaagatgctgatggccgtttgtagctaacttaaaaataaaacaatctcctgcatgttgtaacatctgctgttgttacaaaattactcttacttaataattaaataatttccgatcagtattaattaatacactgcatttcagacaataattatcatagattgttgataacatagcagtatatggtgctggcagttccgcatagcacaagtatacatgcatcctcattgcaaattacctcaaaagaggagaattccttcaatggggtatcagacggtagtatgacaatatctttggaagtttcgtcttcatttaactgccaattgttttgagtatctctactaaatcttaaggatttgatttgaaatgtgaaactcgttaatagagcaacatagaaagagccattttcgttaatccactgagcttttattatcgcatcatcgcactctataacacttactcttgaattgctgaccgcgtcccaaaaaatacaatcaccatcaatggagtaagagaagaaaagatcatcaatgccagcacaagcgaccataccagtaattggaccttcgtggaatagagaagcatcatccacatttgaggtgaagtttggtatgaaaccattgtttccttcactaattttgtaacaccctttgttatcaccttttagaggtaattgacacactttgtaaataaagccatcctcgcaaccaagatatatggaagaaggatcagatggcagcagtagcatactaattatgctcagttcgtcataaagcgacattatcaataggtgttggtaatacttgttatcttttttagtctgttcagtagaatatgataagtccgtccttgggataggaataattttgacatcgtcatcctcttttaatgataaatctaaggttgatatcagcttaagttggccattggtgctggccgccaggatgctatggtcattgaattttggaattataattgaaagtaccggatagtgatgataattagtggaaacaatatttctttccacctgaaagctattatttattttgactgttcgcagttcatataagatgagttttcctgtatagcaagaaagaacgacggaggtaatcttagaattaggattatcaataaacttgctccgtacaacattctgaccttggaataaaactgtatcaagtacctcaccagaagagacgtgtgtgatttgaactaaagagcttttcacgtatttggttacaagatgaatcacagtaaccagtaaattatctaagacgtcactggaaatgacccttgcttcagaagttgaatcaatggcaacttttggtgaaattgataaatacatgcttattttcccatcaccagcgatttgatgagaagatgacttgagcgcagccgcttctatagtctcctgtagtgaaaatgtttctttcttcaacgttgcgtagtcttccgctgaaacgacatttccgaaatcaaacacatccttttcaacaacttctttatcctccttggtctctgtaatatctgaagtcgatgcttgctgttctataagatcttgggaaggtagatgtccatcttccataatttcatgtttcccgtcatattcatctgtctgtattccgatatcatatgttatcacagcctccttaacagcgctcaattcaaactcatttacatcatctgtttgcactgagatctcaacagtttttacttctttcttgacttcagattcgttgttatttatggaattggtgatatgggaaatgaacggaagggtacaatctgctatctcttcatgtttcgaatcaatttttttcctttgcagctgaagagcctctattttctgcttcatcaactgtaagcgctcattcttgtccatatttctgggtatattccccctgaggttggtgttgctgatgagcgcttcttcactgacgcgttttatcttgcttcatgtatggatttgttaagcgtaaacaaaagatgataaataagatttgagtattatcaaaaatacgatgttacagtaagttggatgaatttcacaataggttggaggataacacattgcaagtaagtccttcttgtctgaatacacctttacagcaattataaaagccaccccggtgtactatccgaacacttcctccgctttgagtcctggtggtaggatcatatttctttagtacaatgagcattgatattgacgacattctagctgagctggatagggacactacagctgttgaacaaaatgcttcttcatacccagaccaaagcgatcgaactcaaggcaatgatgtctctcagataagaccagcagataaggcggttgaccctgtggctcccacacagtttaacaaaattgacgactatcaaaagctaattacacattggaagaatgaacgtatgagtccggagctgcttccatatccacatcatctcatgactaggacattaataaggattcaagaaagaattgaactaatagaaacactatcaatgggatacttagaagataatcaagagttaactgtcgattcaaagctaccacttttatgcatggaagcagaacttgagagattgaagttcctagttcgatctttcatcagatgccggttaagcaaaattgacaaatacagcatttacctaagacaacaatccgaactacccaataatgcgggcctcagcagactagatttattgatgtccaaagaagaggtgaagtaccatatgaagcattctgacatattactaaaactgtttaacaacgcagtacttaagcacttaccagaagaactgcaagccgttaacgatactgagggttccatcagtatgattgatgaacccgattggaataaaactgtatttatactagtttgtggtggggtagttgacgaaagtggtattgattcgaaattaacgaccgatgatgatggaaaacactgttactcagtgattattgaagatttaaatgaagaaatttacttattaatcggggcagtatacgtaatacgttatagtgtaatacgagatctcatgactgagggacgagtagttttaatataatgaaaattctgaacagtattactgaacctatgactcttcgaaaaatataggtttgtaacgaatgtttgccagcaataatttctcaacaatgttattgcgaacacagcatgttttctacctagtgttattgactgctggtctatagtgcttttgaaccaatttgtattagtattacatcaattaacgttgaaaagtctatctagcatactcaaagtgtacctatttttcatatttactgtatgcaaaacccatccggcaagcatatgatcagctcagagaaatccttcaatatctggtttctgggcttgggcaagcttagcccttttggttgtctgcggttgagattgagataacgacactgaatgtattcttttcaatcctgtagtcgagttcatctcaacgacagaatctaattcctcgatattttgcgagttggcatctatgttactggaagaggactggtttatattagatttggcatgttgtgatgatctagacttcataaattccataaacttagggactaaagctaactcctcctgtgtctgtttatgtagaagtgtcttgtttgttttctcattggtatccagcttcccctcgtggaacaaaccagtggtatcattgaactcaagctggaaagaaacagtgacatcattgattttatcccatataatttggatttcatcgccatcatgaagtaagatctttgtgcccggagtgattttctttccattaacatagcttgagttagtaccactttggcaataccatacatcatcaagaccttgagctggagattcataaatactgtcaccgacagcgtgtcttttcttcaatatgaagcaatgtatcctagataaacgattatcatcaattttacagttgcattcgtctgacctaccgatgaagaatggatttatcccttgttttacttggaccttacctgaaatagatgagccaggtaaggaatgcaaagtgagaaatagcccctccccattgacctttgtaagtggtctattgatctttttgttcttattgtttgaaagtccttcttcaccagatttataattaacattaatagctttaccagtattaggatttgaaaagttaaactgcaagttttgggattgtgcaattttagatggtgcaatttgtggttttttgaatacaggctctttattagtttctgcagcaggcgccgttatttctttcttgataatctctaacctctttttcgcaatgtatgattcgtattcagcctcattcatactgtcaacaaattgttgctgggacaaggattgtgagatggatatttgtgactgcatgctatcaacgtatgccattttcatccatggatgttgcagggcctttcctgcgttcattctttctttagggtccacattcaacaggcaatctatgaagtttcttgcctcttcggatattctataatcctttaatggtccttcatgataagagccccgttttatttgcttgaacaattcattctgagactgaccactaaaaggcaagtgacctgtaagaataacgtaaactaggcatccaattgaccacatatcaacaagtgaggaatacagatctcgattagttttatcttcagcatttttcccgtctataacttcaggtgcaacatatgctagagtaccacaaaaagtgttcaggaatgtattctgattttgtacttttgccaggccaaaatcggttatctttataagaactggatcgtcttgctctatcattatattatcaggtttcaagtctcgatggctaattccttgatcatgcatgtattttactgcctctaaaacctgtcgtgttatctctctgccggcatcctcgcctacagttccatgggctgctacgaaatccattaaatcgcctccgctgacaaactccatcaacatgtaataattatcattgtcttcaaaaaagtccttaagtttaactatcctggggtgatttaatttctgcaatacatctagttccctcttcactccatcaaatttatccattacttttctcttatgaattattttgaccgcaaatgttttgcctgttgacctttcgacagctttcttcacagtagcgaaagcaccttgaccaacaatcgaatctgatatcgaatagtatttgtgtattccttttaattctgtatgtcccattgatatctgatatttgctctttgaagatgaagcaggtgaagtcacatccttcatcatattgagttcttttagtctatttttgaaactatcgttgatgaaaatcactaaactaacgacatcgctgggaacgccgactccaacacttatttcatccccttgggtcaagatgtgattcgtatccttttgtatcctcgctccatttaaccatgttccattggttgatgtatccttcagcattaaagttccttcttcacccagcattagcataaagtgtctgttggacagtcttgaaatatcccccagataataatcacatccttggtttcttccaaaggtccatgtttttttaattgatgattcctttttgaatatactttcaggttgaaccttcaagtcccgtagacttatttgaccagttgtacatattactctgcacaccacatcgtcgtctattttctcctgagaaaacttatctattaggtacttctgtgtagcctgagtggcttgttgtgtcggttgcgttatatcatccatgtcaatatcttcgtttgcacagcaatgatcagttgatctctaaagaggctgggaaaggtaacggcaaacctcaaagggacaacttaatgcctcaatatagaacgattttcacaagtgtgctattctatagtcggttgtgactgtgtatacccactaaactgccaacacaaagctaatgaataatggaataaatcgttctttcataatgtgtatgatcgcttttgcaattcaaagatccagattatttcagaaaaatgtcaacctttaaatcgcgtaaatattcgatgaacattaaatattacaatgacgcgtaaaagtacatacatatatacaaagccaatgatcaaagatggatcagtctttactcggcactgctacaacgttggagtgggaatttgagtaaatagaacggaatcattgatagaagttctattatggcacattgcggcatcaggtgattggtgccgaatcttcttcagaactatgtgaagccggtttatactgcaacaatccatatggcatcaattagtaaataccatggttgaataacttgtatcagctgtttcttattctaactccagtcatgctacaaagactttaaaatctttacttatcaatagatggaagtaaagattataaatcgatatggttgctatcaagcataacactccgaattttcagaaattctttgcattttgctcatataacgttattgtatttgaactgttagagccttttcttgaaaaaactaggttctattcatgtttaaaacattcgttaagacaattccccataaccgattgaagaaatgatatatataagttttcgttttattaatactgcaataatgtccttcaacgagatagctatgtagtaaaattatatatcagctttgatctactggtgaaggttcaaatcataccgtcaactttaaccgtaatgttacggtaaataacaaaatcgtaaattattaatctcacatacctccataacgttatgttaagtttcttaccattctatctgctaattaaatgacctgttcccagaatcaggactggataaaaagtctactacatccgttagtttttcccaaggaaaccctttaaatacaagagccgggctcagtagtctttcgcgtcagattttgaagtctatttatatttactactagttcataaattggacattgtataggaaagatgcattcctctacataatatttttgttaaattaactacccatcattacttccctaaaaccatgtaaactgataggtatggtgcataccagtacaattggcaacagcttgcaacgttaagattcagtgatctcaattaaattacgattttgacagttttattttaagggaaaaagttgctttaaaacaggaaaacgacatcaggcaatgttttgcctcagtaaacaaagatacaattaatcgacaaaagctgggcaggttcattttttgttgaacttgaacgtctaatatcatttacttctgagaatagacgtaaatatcagcttatctgttttactttgagaaggttcgctgctaggtaattaaagttacttcgaggcttggaacaagatgggtaaggaacaaatcagaaagagacaaactaaaaaggtacgcaagggttcacaacccgtggcaaatggtaaatcttctgtagtaggggtctccaaagatgggaaaccagaattttgtgctattgatacgcccatagaaaggagacttcaaactctcagcgtagcatggtatgtcgaatgtattccgttaatgatcatcataatgttgtttgtttgggttaacccgttgatgtggtcgtttgtaataccatacaccatttattatttcatagaccggactgcctccaatgggaacgctgtgaagagacactccaagtggttccgatctctaaaggtctggttttatttccgtgattacttccctataagtatgcacaaaagcactgaactcgagccaacatttacaagtattgattccacagagctggaaaatgatgcgagtgagccaggctacctggatagctcacagcccgttttaccagataaatggtggaatcctttcagagaaaaggatgaaactgttagaccaacaggaccgaggtatatttttggctaccatccacatggtatagcagcattcggagcgtttggagcattcgctaccgaggcatgtaattggagtaaagttttcccaggcattccagtgtgtttgcttactttggtaaatcaatttcaaataccagtgtaccgtgattatttattggccttaggcataacatcggtcgctagaaaaaatgctatgaaagtacttgagaaaaattattcaatagccatcgtaattggaggtgccagtgaatcccttcttactaaccttggttcatctgatatcattttaagcaagcggaaaggttttgtgaagttggctttgcaaactgggaatgtgagtcttgtacctgtgtatggatttggtgaaactgatacttacaagattctgaagcttaaaaatgactctataataggcaggatacagatatggcttaaagagaactacagcttcactgtccctctatttttcgctcgtggtgtattcaattatgattttggtttactaccgtttagacatccagtcaatgttgttgttggaaaccctattcatattaaagaaaagatagatcatccaacaattgaggagattgatcattaccattccttatacattgaagaattgaaacgtctttacgatgataacaaggcaaaatttaactattcagaaaaaactttaaatatagtggaatgaaactctttaccaaaaaactaaataaaatatgatactgcctcgacggtgaggcagcattcagtattgtctctatatatctgcattaccaccagacactacaattaaaagtaaaataatccaaaccttgctaaaacgaaaaaacctccgcttttgtgagttgtactcagtctcaccgtttccttactctgtcactaacaaattctcacgtaactcatcaacagtgacatccttctttagtcgatcaatatatatcctttcccacttatttatattccgtgcaggttgtttacctaccgtaacaaatcgtttcgggactataagaaaccgaacatattttagaacctttttagtaagaaaaagattaaaggatggctcttagcatcacagaagtagagctgtacacgacgcaatacgattgcaaccagcatttccagctaaatcatggctattaagagattaattaacgagcatgatatggagttatggaataactccaagacgtttgaagacgtgattggatttattaataccttggcattgagtgtacggggcagagagaacaatgattacactcaaccaattagtgataacgtccaaagagtctctaacttgttatcaaaagtaacagaaatcattgggaagcatgaggttatcaaagatgctaatacctcgagattcggtaagatcgaatttagggatttttatgatgacatttcggagcactctaatgagctaatatcaaagatatttgaaggcattgaaaaacctgacacagggaagttggatgacatttgtacgtatttcattaactcttggggggataggtcaaggattgattatggttccggtcatgaattgaacttcatatgtttcttgtactgcttgacagaatcaaaggtatttgatctggagaacgacagctcgaatattgtattgatgcttttcattaaatatttggggataatgagatcacttgagctcaaatactggttggagcctgctggttctcatggtgtttggggtctagatgactatcactttttaccttttcttttcggtgcattccaactatccactcataagcatttgaaaccaaaatcaattcacaatccagaagtcgtagaaatgttccaagacaggtatctatatttcggctgcattgcattcattaataaagttaaaaccacagctagtttgagatggcattcacctatgttggatgatataagcggggtgaaacggtggtcaaaagttgctgaaggcatggtaaaaatgtataaggcagaggttctacaaaaattaccaatcatgcagcatttctatttcggatatttcttgaaatgtcccgagggcgttagtgaaccatcagcacgcgcacaagatcatcatgaagatgattcatgctgtactgatggatcgcatggtcatagtacttgggcggattgttgcggtattgcagtccctagtgcgattgcggcatctcaaatggctaataaagacgtaagactatttccttttgattgaataatattacatatgatgcgtataccgaaacttaactacccttatatataccaacataacgttaacaaacaataacatagaccgcaattcacgatgcattatttaccatgcgaaacgtaattgtgaagcggtaaatactgggggtgtccagattaatttttgaggatctatagatctcctcttattattctttagctttttgtaccttttcatcacatcgctattcaaatacagtacatgctgacctcgatagaaccttaatatttctaaggcttttgcagtatgaagaatatcagtggtagtcatagaggaaattgaactaacttcatcgatggtgatttcctggccgtgctctaccaaaagcttaatcaaggtgtcggcccagtatgctctgtaagataacaaacccaaatccgataacggcttttctggtgatccgactttaccctctttcttagataactcataagaaaactcgattaatagtctaccgtaacccattctttgatattgaggtagtgttaaaatacatgccacattataagcatcagctgattccttttcctttgagaaataaccgacaatatgatggcctagttcatcacgcctagtcatacagtaaaataaaaatggatcaacatcatagtacaacgttttatgatccaagaaaagtttagacaaaagacatagattacggcaccatgtcctctgtttccgaccatcaatttcaaagaaggaaacatagtcatctctatatatctcgttacctggaggatgtcgtagagtacatttctttctgtatcgttcatattgtttctttgatccgaaatattgtagggaaaaatcatcgatatataccacatcctcatcagtcaactctattggataaggtgaaaagtaccatggctctatttcatatttgcccataatcaccttgttcaaatttctaactctagccacctcattctgattctgtgtcattgaccccgatgtacgaagcttctttatttcatcttctctggaaatatcttcattaggaatcccttgtacattcaaattatccaaatccatcacatccccaccatccggagtagcactggctgcttgtggtgtagcacttttattctgttgctgcttctttttcttcgagtctttcttctcttcaagctctttaggcctaggaaaaatgacttccttgtctatctgtaacctatcagcagtgatccattcatctagacgtttattgaagtcttcataatgcacgtagaacttaggtggatctcttctgctgttaatggatagaatttcagcaagacgatcttgaccatcttttagtacccatgacttgcatccaacgaaaatctcatcgatgctgtcaaccttctggggaatcccaggttccttttcttcgccgtgactcatgtattagcgagctcgcccaaaatatttgttaaacagttgccttgccttactagttcctcttacagaggtgctctgtttttggatttggtttattgcgtaactaataagttcaaatattttgaagatgctaaatttcagttaatttattcagattaccgtattaaagcaaacaccatgcttgaacaaacatacaagaaaacctgacgttccctgtccttgactacgtgactgtaatcatatgacagttagagcaaacctcgcaattaatgcagactgaaatattctagatagatggaaaacggggacctaatagagttaaactacaaacttctacataagtcgctgcaagtagacaccagctagattagaatctttgagatattaacgtgggattccacggcaagccagggaatgtatcttctgtagcatcagggacttgcttccatattttgatgcttttgtctccttcccctgtgatgagtcttgttcctgtgacatcaaaggtgctgcataaaatcgatcgctcactttcaagtgagccagcaacttcagttgtcatcatactttggtatttgtgtcctgttttgtaatcgtaaaagcacaaagtaccgtcatctccaccagctaatagtacattatcgtgattaattgatacggtattcaaaatcccagtgttctgggattgaaagttggttaatagctgtccttcgggcaatttccaggatctgacgtcgttcgtagatacactggcaaagctaaactctgctgggtgtagcgtcaagtctctgatgtttctactatggtgcgttaaaactttgcttgccttccctgcaatgatatcccaaagtctaactgttgcatccccggaacaactgattatttgtgggtcaacgggaaggcatttgactttatttatagggcttttatgaccgggcagaaccattatctcagatcttgatcgtatatcccacaaccttactacagcatcacgaccagcagtagctattatatcaaggctcggatgaacatcaacggtatgcacgccagataaatgaccgtgaaaatccctaattgcagtatttctttctagatcccaacattttacaagtttatcttcgcttgctgagaacatataaggatgtctctttgagatagcaatatctcgaacactcattacatgcccgattagagtaattttcaactttcccgcagctaaatcccagattttaatggttgtatcgttgctaccagtagcaaaccattcattgtcaacggggtccacgcatacacatcttacccatccagtatgaccatttattaccttactgagtttccatggtgcatgccattgcggtttataacttcgagtcttttcataacgttccatcaatgaaatctgctgatgtggctgttggaacactcttcgtactagttggtcgcctggttttgtggtatgtttgactaatgcttgagagctttcgtttgcaacagttttcgacacctcaactaattcactgtacctttctaaaacagtcttttcttgatccaggcacttctgtaacgactcaggtaaataatcagcatgtttaaattcattattccaccgagtttgaacgtaaacatcatctgctaccttcgaaggttcagagctacggctggatgtattcattggtacttattagttgtctatcagttcgattaagtcgtgtaactctctttcatctttgtatatgtcacttcgttaacttttcataatatccatcatacaaaacggttcttttcgtttcttgaaaaatttcgagctcatctcatctcatctcatcacattgaagcagaagtcagttgttcaaatctggaagctgcgcttcttaattgcttataacaagtaccaggtattagtactctcgtgttaaagtatagtattggtataatgtcagaccaatctttgaaaagagagtccgaagctgctgcccagcaagaagatattaagaggacaaaagttggtgaaggtataaatgaaggtataaacaataacaacatcactgaaaaggatgttggtatcacgcattacttatcaatggataatgttggtttcaatggtcagatcaaacaaaggtacactgactttttagtcaatgaaatcaccaagcaaggcgaagttgtgcatttgactgacaaaggttttaatatgccaaagaagccaaagccaacgagagaacaaatcgagcaatcgcaaaaagaagaacttgagaaacgccaaggatttaaggtggatgaaggaattagaaatgaacttgttgaacttttgggagaagaggatgttcaaaaaattgaagctgtgtaccgctcaaataaaaagattgaaacatcgaaggcattcgatgataaacttgaaaggactaaaatacatcaactgctacgtagagctttcgacaacaagttagaatctgtaacgacggattcaaaccatttcattgttggaatggcttctcgccaaacacgtgttagcaaagaagaattgatcgaacaaactaaggatgcaaacggtgtcgaaaactggggttatggtccatcaaaatcgtttattcattttactgtctataaggaaaacaaagatactatggatgtcgctaatactttatcaaaattcatgagaattccaacaaggttgatcagattttctggaacaaaggatcgtagggctgtcacttgtcaaagaatgtctttatccaaaattggtttggacagattaaacggactaaacaagggcttgaagggtgtcgttctaggtggctacaaattcgaagatgagccattgaacttgggagatctacagggaaacgaattcactattgctatcagagatgtttcattgaagaatgaaggcgatgatttggatgatatcctagccaatggcatgaaatccttggaacaaaatgggttcatcaattatttcggtatgcaaagatttggtacgttcagtgtttcaacgcatcaaattgggcaagtcctattatcaggtaactggaaacaagctgttgatttgatcatggctgaacaagaaaatgttttgccaatttccaaagaagctagaagaatttgggcacaaaccaggaacccaatctatgcagccaaagcaatgccacatcagtgtttggcagaaaatgccattctcaatgcactatgtcatgaggagaaatgtgaaacatcaaacgattaccctattagctcatatcacaatgctattctaaagattcctagaaacttgagaactatgtatgtgcatgcttaccaaagttatgtttggaacatggtcgctagcgaaaggattaaattatttggattgaatgtcatcgaaggtgaccttgttgttgacgaaacatctgctgctgagtctgatgaccaagccaaacaggacgaggatgactttgatgaagacctccgcgaaacgaagtttattcgtgcaagaccagtgacagcagaagaagttgctgctcaaactttcaccgtgaatgatgttgtactaccaacacctggttttgatattgtctatccgagcaatgaaaaccttcgccaactatatgttgacgttatggcaaaagataacatggatcccttcgatatgaagcggaaagttcgtgatttttcccttgccggctcctacagaaatgttatcaataaaccaactgatatcgaataccaagttgtttcatatgaaaacccaactgaccaattgatcaacaccgatttagaaattctgaacgccaatagaggtaaagacaacggccaaaaatacatcaaatcaaaactagaaagatacatgaaagtaaaggatggtaacaaaaaggcagttattatcaaattcaaacttggagtgtctgcctatgctaccatggtattacgtgaattaatgaaggtggagacttcacgccgtggtgacatgtgtaatgttagtgtctgatccccgacaaataagcatctcaattattgttgtatactgtaaattagcattcttttcagaaactcttctttggcatccaagagataacttccttcctcttctactgattcttagggactgtaaaatctttattgaaagagggtcgcacatcgttttcatagtctgactttcatgtcagtattcctttcgcaatacaaatctttttcttgatatatcactatgtgcaaaaactgacaccgtgaggtcagtgtcacaaacctaaagaatcggactataaaagcaggttaaattgtgagaacagttgtcatatctgtaccaaccgaacattatatataaacggatttgtaacttaatacacacaacttttaccaaatagccaataaatcaaacaaacaattgctactcaaccatagtcactcatttttttcaacaatttcattgtaaagggataatacaatagcttaaatgatatcagaaggtagtttcttggaccctcaaattgaagcaacgttatatggacaaaagaaggcctctaatttaggtacttttcaaacaaattcgactgcgagcaagacttcttcgttaaatcgagagttatttgggttcagaaggaaagctaggcaatatttcgagacaacgacgcaaaggtttcgtgaacatggtaacgataaggagttgatgagagcaggggtcaattataaaccaagatcagaagatgaggaaatggaagaacttaataagtccaagcttatgatggatatgttatttgaaaaagcgaatcatggctccaaacaggattttgacaagcttggtggaactggaaaatatggtgtgcacatatcatcgactccgaaaagtgtaccggaattgctatgcgaagccgtctaccaagacgttcatggagaaatatctttggcaagtcccgagtctgaatcaattgacatttctaatagtgctggcaggagagtagttatattccaagatttgctcaagaacattggcgttgggaccttattagctcaggtcagcggtggtcctttggaaaaggtgctatacgcttatgacaataagacaggttcccgagatgtcgtttatgttgaattgcatttcttgttccctgatgatgctgctcagtttatgaaatacgccagattccacctattcaaagtgaacggtgtacatttagttccacattggggtgtaatagattctctagactcctctgaaaagagtcttttagatattcaacagtatgttcatccagatttttgtaaagatattcaaaactttgactcgactggagcacgtcgctgcttaattatgaagaaatattcaaggaaacataagtcgatttctacagagttgaattcaaagtctcacatttatgatttggatatccaacaaataatcgatgattttaatcaattcggacaggttctcgaggtatcaccgttgatttctcggaaaatatgtttgcagatcagtttccatgatatcagaagtgcaatagaggcaatgaggagttatgagacttccaattcctacataaatggcaagtattttaaagactggtccatctggtatggtaaagacattgtagataaaccatgcattgaagtgtagataaagtttaatattctataactaaatagcattttgtacatatatacataaacacataaaagaaataataaatttgttcgaggttcttatcacttggtggttaaaaacgaatagtttggtttaggttggctttccgtctagtactaccaagaatccacctactaaatgcaacgatcccgtaacaaatacgtcaactggttcacccatattcttgattagatccaaagcagcttcgattgatgaagtaacttctacatttctgtgttcagtttcatttaataatatccattccttctgcaaattctgctgaacctctagtttgtcaacttgctctttagatgtgtttaaggaaactaaatctgcactataattacctgtcttccacgtcacattggtcgtgaatattgcagcatcaaattctactgcgggagagatagtttcatataggtatcccaacagcgcttttgcatcccttgactgctgattgaatagtaaaactttttttctattgaaggtcgcagtcacgtccctaaaccacccactggcagcttcgatactttccttggtatgcgcgccatctatgtaccatgtaatgttattggagcgaatgatttgacaacgtccttcccaaacggtttgctctaagccttttctgaatagatcagggattttggcagatgacgctagttctaatggttcttttaagatatcaagtgaaaccaaatgttggtgagctaatgcagtagctaaagatgcatttttaatctgaaaatcaccagcgatgcccaacttaatggtttttaaatgttcaaaaatgggaacctcggaaagtgtagtgtgtctctcagcagctctttcttgcaaaacctgcgatccagttttgggttgtgattttactgtgaatgcaggagcaccttctttaaagataccacctttattccatgcgatttcttcgatggtattccctaacatgaatgtatgatcaatacccaatgcagaaacaccgcatacggttggtttctcaatgatattagtgctatcaaactcaccaccgacaccaacttcatatatacacgttccacatccctcttgcatgaatacatggaatgaaagaagagtcaagtacttgaaatatccaggtttttgaccctcagtcatatgaggaaacttgtcttcattggaagaagtttcgtccaatctatcccaaacttcaaagaaatatttcgagaacaattcctcagttattggctccccgtttattctaattctttctctcactgaccttagatgtggagaagtataaagaccaaccttactcaatgtatctttatattggttcaagataccttgcgtaaacgcagcagttgaacctttacccttagtaccagtgatatgaatcacgttcaatttgttgaagtcagaaactgaataccctatacgacgtgaccattcttgcatctcccaaatgttcatcatatttttcctatcacctgatgctctgatagccataatattggcatagttagattgtaacgaattcaatgcctgaacagcatcctgataattcctattcgccattttcaaactaagcggtaatcgcatatcacagttcaatacacctccctcaattaacgaatattatcgaatactaccgcttgtgtcggataatacaattcagtagaagatgagtagtaattcagaaaatgcactgcttcttatcagttaaaaagtcaactcccaaagaaacctattggagtgtgcaagcaaggattacgctcacgacctaggtatcattcaaagatctcaaacttctatatgcacataatctgtaatttgaaatatactcgttgcaaagtacgcttttgaaggaacctcggtaatcatcaacatttcatatgcatttggttcttcgagagccatcgcgaggaaaaatgattcccatattattacccggccactgaataatttttccgaaagtgattcaagctttatttttctggaaaccgtaaaaccaatcacgtgaatgcatggaatatttgattgacagtttcctaaatgatttcaatcaaggaacatgagaaacgtatggaattccgttagatataacatagctgttggtgtccatagaacagtgcaaagcagggaaattaaattaataactggtgttaggcattgctggtattttcttcttagctgttttcaattttcggtccatattttgaagcacaattgccagcagattgtttgttaataaattgaaacgacatacggttagtgcgaatctcttggaaaaagacgttttatttacaggtttttgtttccaacaaaggttctttattggtctaactttaaatttgaaattttggaagcattttactacctgtgctcattagttgacgtattgattctggttggtttgggatttttttttgtttttatctgtcctgtacgtggttccgtcaggttgttgtcttagatgaatcagttgttaaactaacacgtcgcggaatgttcacaactagagcggagcaaaacaatatcaaggccactattgccgcttcctacgataagctatatagccaatttagttcggatgaattaagtgaaattggcaactataaaatatcgaaatttatcggggaagggtcttttggtaaagtgtacttagccacgcatagattgacccatcaaaaggtggtgttgaaaaccggcaataaaagggaccctaatgtggtacgagaagtgttttatcatcgtcagtttgatttcccgtatataaccaaactttatgaagtcatcgtaactgaatctagggtctggatggtcctcgagtattgttctggtcatgaactttatgaacatttactgaaggagcaaaggctttctcttgaggagtcaaagaaacttttttcgcagatagctagtgctgtttattatgctcatgaattgaaatgtgttcatagagatttgaaattagagaatgttttattggatgggaatggtcacgcaaaacttacagacttcggtttcacaagagagatggctacaaggtcgcagttagagaccatttgtggtaccacggtgtacatggcgccggaattgattgaaaggaaatgttatgatgggtttaaggtagatatatggtcacttggaattattttatatacgatgatcaacggttacatgcccttcgacgaggatgatgatatcaaaacaaaactgaaaattgttaacgatgaactggatttcaatcaagagtggatctccgatgatgccattgatcttatccaagggatgctgcgcaaaaatccgaatgagaggatatcattagcgcaagttctctcgcatccattccttcaaccttggggtgtagtcgctaaagagaaaactgataaggtgttgctgaaacagcgaggtggtcatgttcatttccattcgaaacatgaaaagcgtttgttgaaaagattgaagcaatgtggatttgatactggttctatcaaaaattctgtcaacaaaagaaaatgtgattccttgagcggcttgtggtttttacttctagaaagatacgaactgagcgatgcaaaggtaccgaaaaggtcaaaatctgtaatgtcggtacgaaaagttttcgaatcatctgtaaacatggttatggatgatattttggtgacctcacctgaatgtgttaaaattaactcattgaagaagatactcagtcgtaaaagtgtagatcaagatgttgagctgcctcagactattgaagatgtgaaagtacgaacgcaacccaaggacaggaaagctgctgaaccggagtcaatacatccagctgatacaacaaacaaaaagaaagggtttctacaacgagtttcttctcttttcaaacccaaaaagcataacaatcatgtcgatgataatcagtcaataaaattttcttcccaaggcatacacccgttgctaggcaaaaaacgacacaaaaatggatcgaatgactcagaagcgccttccatctctcaatcaactaagccacctcctgaacaggaagacctcaacgtccaatttgaagatataactaataaggctaatcacagttttaagaagttgaaatcacattcatcaagtgagatttccaagaacattaacgagcctcagttgaatcatttacacattgatggaggaactgaagattcactgaaaatatcaaacaacaggggtatcaggcggtcctccattgcctcgcagcattcagccatttcaaatgatacgttcaactctgactactctactgatgctcaatcggggttcagatctaacaacactcaatcttcaagtaggatcaacgcaaattcagaaacttcagcagccactcggaagaatgtacgaagaacgttgagtgtattatctagtgcatctagtaactcagagatgagttcaagaactgactctttctatgatataacgactgcttcctcgccaatgaatatggatatccgttcaaattacaacattcgatcggattctcagttccctaaaattaatggtaactctccatggctgatcaaaagaggaaaatctccgataggaaggcgtagccgaatatctaatcgttctttaaacaggaaattcaggcagccaactcccaatagagctgattctgttattcaagaagagagctctttcgatgaaaatgaacgcgcttctaatttaccagaggtaagcgagtatgatagtggtgaaattgccattcacagcgacagtgagacaccttcaaaaggaaatactccgctgtatgctattgggattaatcacccggaatccagacctgttttgttcaacgttggcagatctgtaagtgatggtagcagctggtcacatcctcagtcggatttccatgaaccgttgagtgctccagtaattcgaaaaagttctcgacgtcatgtagaggatgatgactatgagtctaatattgcagctgatgacgaagacaattctttggaggatgaggaacaagaacacgtaagatcaatagccgaatcggtctaagacttcatatgtgtatagattcataacttttttaactcgttgattgtattgtttacctaaaacttgaacatttaattcagaagcaagtatcacggttcttgcttcttgagattctgtaaaatcgtttgaagaggtccggaaggagctccatctacagtgagtgacttgacaaggtcagcaattggagagcattcagcagacacatcttgtaatgattggtgaagttcagaaagtgtatctaactcagaatctgcaatctgatctttatcagcatcgctgtccatataacttccacgcaagttagcaatgtaatcgtcagctaagtttaacccatttttgaggaagaattcaaagaaatcgtcttcatcgatggaaatatcagagtccttttcaagaaaggattcttgttcattatcaacatgcgcatcaccattcacgtttctctcatcagaattatcattgatgattccctttaaatcggactcatcgttcaaaaaagataatagattagtctttaaggtatccaaactggtggcatttaattcaacatcatcatctgggttaaggatgtcccattttacgtttgctatctgaaagtcctctgtaatgattttatgctcctgtaaacaggatagtaacgctttcggttttaacctgttattgctatttaaagttaggatatcattgtcaatcatatgatgaattgaatcgaccaacacgcttccaagagtatcactgtaaaagtcaagtttattgtttagctcttggtctgtactcgtcaaatcgacgaacttcttaacaagagccaagtgagattgtggcgcaatgacatctatcatatgaccatcttctgtatgtttttctgttggaatcgtctcaaaagaagacgtcataaaatgagtcagagccaagcttaccagtttaggattgtatttcaaaatttcggccacttttgaatcagtaattatagttttacagcatttcagtttgttaagagtagagtaggggaacacttttaggaagttctttcgtatattactttctagatccggaagataggaaacttttgagctgtctttcttcaaaaacgatagtgcttcgtatttactaaggcctcgatcataatagaaagtaatcggtatataactgatcttgcccattgttatccatattctgttattactaactggaaactctagctcagcgggaataatctcattggcttccatcaatatgaattcaccgtctgtatcacataccttaataaatgtacacggtcctgcatgtctcgagaaatttagaagtatggataacaccaagcactcctcatcacgagcgttatcccctacttgaagcgagccaaatatatagtattctccagataaagattctctgatctcaagtgatacaccgttataaccattccatgggaaagcttcattccagggttccaacattgaagacaactcagaaagttgtgacttaagtataatttgatcttgatctttaatcaactcgtctaggtagaatatcccaaacatcatggtagtttcatgttcctggttgaatatgtcatcgtttaattcagttgtttcctgctgccatagaaagttatcattcacataaggctgagtcttagttactagcatctagttgtttgtatagcccgtctgagcaactgctgattcacgtacgtgttgaactgctatttcctggatttcattatctccttttatctcatgtcatctcatcgttcatttcatgtatttcatcgtttcatctaaattgagaacattaattaaagacataattaaggtttaccaagttcgaacgagataaaggaagaagacgataatagggcgtagaataaccaatatcaatggaagagctgcgagaacgtgtttggcatggttcactcaatgtggaaattatgctatctgattcgatagtagtaccgaatacccctctttctgagaaatgctatcacatagttgttttgcgagaatctttcttggcattatatcttccagcaatagtacgaaagcttggaaacaatgtgattgtcacgtatgagaacccttataagcagtggtggtttgaatatgatggagtgcccgttccttgggagtatccttgtggtgtactattcgactttttatgcaactcttcgaccacttcaaccggtaaagaagatgatcaacgactacagatgtggaaacttaaactatgtcacgggaacaaatatccacctgggatacttccattggttgatggtttgcgccaagtaaaagatcactggaagcaccagtggaaacaggcatgtttcattctaaatggttctgcgaagcgtattatgtcgttatcaatacctgattttgaagctttctggcagagtttaatatcgagacatcagccagactacatcaaggttcgggagaagttgctcacaccgaataaaactaaacatatacctataagagtgtggactgcagatgcatcattcctacaaccttcaatacccgctaattccgacactatgacgctgtttgatgttatgacttcaatggacattaagcttcaggaaaataacagagcaattatacaaggcatagtgatctgttcggatgaggacattattaatttatatgatttatttgcaagcattgacggatttttatatgtagtcatcaaataataagcttcagcgtatatatacagtaaaatagatattgaaagttcggagagtttcattagtcaattgacttactcagttgaaacatcattagggacttcaaaaactgcctgtaaccatacacgatacatctttagttgtcttttacgattgaccaatagtcttctgtctgttccaatctgtttctcaacgaaatatttttcagtgaagatgtcgcgcagttcttgttcagtgaagaaatacactcttgttccatctcctctaacgtagaaattatcatccagtagtctattctttttgaaccgtacctgagctagatcataacgtccataatcacggaacagtatcttaccacctggctttaggattttatgaaggttatccattgccttactccattgttcaggtgatagtgcactaaacacgaagatcataacagcaatatcgacagaatttggctctatcccgtccggtaattctccttcaatatttgcaagatcccacactgttgcgtgtccatattttggattgaattgatctgaagtcttcactaactcgacagctcttggagcaaagtcagctgctactattctcaattgttcgttttgattctcagtcagaattgggaagaacgtgttaccggcaccacatccaatttcaaaaacggtaactggaccagcatcaggtttagtcgcttcatataaagatgggaactcgatttgaagccattttctgtctttgaagaaattttccctattgtttttataaaatatgtcccagtaacgagcaggattactattgtatagattcttgtcaaattctggaacagggtccttgtattgtttttgaatcttttcttctgcagccaaaacttgttcttcaccccattcgacattatcccaggcattatggttccatacttcgtcgtcagccttcaatgtacgttttccaaaatcaaatggttcatcacggcctattcttgtatcttttatctccaccaattccaaagaagatgataagctttcatcgttggtgaaagtcgattcaagatcattttcaggttcttctgataaattagtcttgcctaagcgaattttcttcggcagcaggagctgctgattcactgtttgctgcattcttcttcttcttcttcttcttgtttttattcttgttgctagacttagaagcaggctcgttcacgtcttgagtatcaccttcatgctcggcttcatctttatctttagcctcgtctttggcttcagctgaggcttcagctgaggcttcaggtgtctcttcagcctcttcagccttagtaggttcattttcagctacatcttcagaattttcttcgatgacaggttcactttcttcaatttcttccttgacactttcttcaattacttctttgacaaccggttctgtttcctgagctggctcttcttcctgagctggctcttcttcctgagctggctcttcttcctgagctggctcttcttcctgagctggctcttcttcttgagctggtttatcctcttcctcggccgaaccctcagaactaacctgctgtccgttcacaggactggtttcaacagcggaatggttcgaatcacccttgtcctccacaggatccttagcgatgctctcaaatttctttatcaaatcggcaacacccattgtcaaatcttctattaatgctgtttcgcactgttttgaattccggttgaagtaacgactacagacaagcggatcgactgaggcaggcctgtaatgtacgttctcttcggctcttctcgttgacagttttgttgaaaatttttatgtactggatcaaaagagacattgtaaaaagtaaatagtgggaagttctgcgaaatcaaatgccgattaatgtaaaaatacatactcgattatgaccacccttctacctagatggtctcaattaagggtatgcacttcttacctaagatcatctgttttggaagtttctgattcgtcattcgtttggtattatggctacttatgtaaatttcattaattatcaagtttaaaccgaccatttattaaggttggcatctcgaagatgaagaagaatacaaattaagtaatcttgatcgtgggaaattgatatttcgtaccttgttgaatgcaaatattcattccagtacgtaatattatgttccccggttgaaaaccttttttggtccaggttcaaattaggtttcccatccggatcatttgatttgaatgctagcttagtatagatatcaatggcagaaggtcggtcggatgaatgaggcagggttttgaataatgattcctttgaagcccatactccagctatgtatattgatttatgttttagcgatgagccgctgtttactagcgtctcgaactgttttatttcgtaaggatgcatgaacttcttgagtattcggtgtaatcgagatgagctgtttcgttgtaacaatttctctaccctcggcagaaatacgatatctgtggctgcagatatcacatttgtgtttttaaggaatatatgtggtaatatcatgtcctagttacaccggctaacggtgtattttctggtttgttcactttggcgatatatagtttctgtcattgtttaaacattgaaatgttattatattgttctataaaatcaaaggttcgagactaattacattttgatgagaagagtgacacagagagagggagagaaatgtttcccagtacagttacaagtaatgtcagtgctattcatttgagatcttcaaataattccggctcaacgtttgtcaaatccttcccaaagatgatggcatcaacaggttcatcgataccattcagaatagctactttgggaaccaatccaattctagtgaacttcaacttatcccagatcttccaactagcaggattagtgacaaataccaaattgaataccgaataattataacctaataaaggggcccatttcaagtaaacttgtcccagtctatatccaatctttttaccacggaatgtagggttcacgaggaatcccgcgttacagttatgagaacaacggccgatataattaggtttaacgtagaacgtacccaatacgagctcatcccaattgttccattttggatcgattgttttctctgttgtgtttagtacaacgacagcgaacgaatggaaccagtaatcagtaaattcttctttagtatgctcaccgaaatgcggataacttgtgccagattcaacttcttcgttgaacagtttgtacaggaattcaaccagcgtcccgggaatctcgtccgctgaaaagattgggaacgcagtcacttgctgatcagaacctttcaaatgaaattgcaatggttctattgagtcaacagttggtttggtaaaaatcgaaccgtttcttaggttgaaagtagacataatgaattcagaatttggatggtgtttcggatgatgttcacagtaataggaatgtgttcattcggtaaatagttgatgaattgtatggttattaacctacatgactctggactggctgcatttgaattttaggcctgtgaatctttaagtctattttatacagcacctagaaaaaaagatagatatgcggatagaaagatagatagagatagagataggccatatgactcattcgatacgttaaggctatatacacgtacactagatcgaattaaactagatctcatttgactcaatgcggcaagtggcaaatcaaaagttcaaaatccattttccttaatgaaaccggtgaccattttgaataactccttttgtgaatcttcttccggaacggcatgagttgcacccttgataagaccggaattcttcgaccataacttcttatccacgaaacattgccatctttgcaatagttcaagcggtttcccattatttggatagcattcatccttctcggacaatgcaataaggaatgggtctttgatgtaaccaaatgtgatttccaatttttcatcagagagatctgatgaaaagaagtcatcgtcaccatcgggcaacaacaacgaacaccatctataagcagttatcggcgtatctaacatacactcagcgtgcttcgaagacaataattcctctggtttccctgcatcaaccaaagctttagcttctgcattcaattttgataacaacggttgaggaatcacagtgctaccaaattctctatcagaaacggctgcctgcaatatcccaccggaaatcttgcccggatgatgcaacaaatagtggatcgtgttttgagatccagtggaatgacccatcaacagcaccatttctctcccatccttcttcaaataatctaccaacgagtcaatctcttcgtcatcacgtttcaaagaaccagttccaaacccgatataactactggttatctgaatttggaccaaagagtagcccaatggatccaatgccttggctaacccttgcaaataaggaacagtcaacaatccatcggtaagtccaccaacgaatatcaaggctttcgatttaccaatcgggtcaaattcaaaagctactcttttttccttaaaaagatgcaaggtgccaggaacttttgtgctagacatcttttgatttcaccgtatcctcaattaactgcaccgatctcaattgagcagtacatatacattcgtcctactctcactaccagaaacatctctggtaagcatatactcattatcaatgagcacttatacattcttactttcagatagatagagagaaagggtgattgatatgcagggcgggaataaaaactcttggcggacataggaaaaaagaatttgatcacgtgatgaatcacgtgatttacctctttttccccgcttttattatttcctgctgattgcgtctctggcaagggaagaatcccccggttttaagactttcgtctccggattgctaatatctgatgaaaggcttgaagaggagtccgggcaatagttagtgacgtccgtcactcagttgccactcaaactttagttatggagaattaaatggctataattaagtacgatcaaacatctccaaatgatttaaaccctgaaattacgattacgacattttattagtgatagaaaccctggatatttcacatttaaagagacaagtaacctgacttttaatctaaccagttgccttagtctgaaatagtttgaaacaagaagtttcgttcctggagctctctataagttttgttagcgacaagtcagtttgacatattaagtctccttatggaaacaagaactaaaaaaaaaacaactagtttgatataacacgcaaaagatgcctgatatatcggtgaaagttaagctcactaaattacttgttcagcttcattatcatattttgaggttggaccttcgaaatgtaaaaccaaaggggtatttgtctactttgttgcgacattgtttgacgttggttagaagttcttcggaaataggacaaggattagggtcaagaaatgacaaatttaggagacatgcaaagttaattctttgggtatttgctactatcggtataagttcttcagttggtacagttttctgggtcaatagggtgatagcatattggaggaacaagaagaatgcccgagttacatcacattctgttgccaagaaccaattactgcaaaatggcactcgtgagttgtacatttcagatggcagcaaggataagaaaatagtggttacgccgactgagaaggatcaatatgaacacgataagtaccttttcaagaatttggaaagggatgttaaatcgcaattgttcaattctaaattccttcaacagttgaatgtgctttccacgatcttgataccgaaattcttgcataagaatagtttgatgctttcagcccagattttctttctaatattgcgcacatggttatcgttgatggtggctaggttggatggtcagattgtgagggatatcatctctggtcagccaagaaaatttgtgattgatatggcatgttggttcttcatagcgttccctgcttcttacacgaacagtgctatcaaatacatacaaagaaaattaagcttaaactttaggtctcgattgaccaggtacatccatgatatgtatcttgataagaggttggtattttataagacagcgttcgataacgaagctaccagttcaattattgcaaatatcgataattctatcactaacgatgtacaaaaattctgtgacgctatcacgaatgtatttgctaacgttgcaaaaccagttatcgaccttgtattcttttccatatatttaagggattcgttggggtcctttggtgtcatcggaatattcctgaactattttttgacaggatacgttttaaggaagtattctccacctttgggtaaattggtaagtttgagatcaagttccgaaggtgactactataactaccatttgaatatgatcaataacagtgaggaaattgccttttatcagggcacgagtgtggaaagaagtaaagtcaatacgctatatgacaaattgatggatcaaatgctacttgtcgatcggtcaaaggttgaatacaacatcattgaagattacattttgaaatatacctggtcagcatggggttatgtttttgcttctatcccaattgtacttcgtacatgggcttcagaggaaactagtgaatctgccaatatgaaagattttatcatgaacaaaagattaatgttatcgctagcagatgcaggaactaggttgatgcattctatcaaggatatctcacagttaacaggttataccaatagagtgtttgttttgttgaaagtcttacatagggtccatgactccaactttgactacgggatggtcagtagctttgatgaagcagaattgaatgcaacttctaccacggtggtttcgaacggcaaaactgctattagaggaactgtgcagcatgatttcaatggtatcagattcgaaaatattgacgtggttattccatctgctagagggattaacggtactactttggtgaagggtcttacctttcaaatcccagcagttattaatccagagccttcgtcatcaaagcaagtttcattagctaatgttagagatccattggatcaatcaaggtttatgatcaatcatggcatgggtagtagtttgttgattctcggaccaaacagttgtggtaagagctccattgaaaggattttgactgaaatttggccaatttataacaagaatgggttactttcaaccccaccaagtcacgatttattctgtgtacctcaacgtccatatttcattcagggaggtaccttcagagaccaaataatttatccaatgacttatgaacaattccatgaaaggggacataaagacacatatttggttcagatactacgcgaagttagattggactatttgttgaagagagatcggggtctaaattatttcgatgcaattgctgactggaaggatgttttaagtgggggagagaagcaaagaatgaacttcacaagaataatgttccacagaccaaggttcgttgttttagacgaagccactaacgctatcagtgttgatatggaagatcatctttttaccatgttgaagagatacagattcaacttcatatccatctctcaacgcccgtctttgataaaataccatgactacctattggaattgactaacggaactgattggagcctacaggcattagggtcagacgaagctattttatcaatcgaaaatgagattgaaaccctaaaccaaaagctaacaaaggtaaaagaatgggaaaggcagagagatgaactacaggcaaagttgacattggtgtgaaaaattggtttgaaaatttaaatctgccaagtcaaatgaactattcttggtgtgtagttcaatcagtagtaaaagtgtcggatattgtattcattactattatataatataatcacagagttaatgaatctattaatattttgctctatataaattatgcaagaaaagcacaggtacgtctgtgtattttattgtacaaatggtacggaatgatgtatagaaagaaaagagcaaattaatctatttgaagtccttgtaagtccatttctcagtgactcttggtttatatcttctaccttttctaatagggatacgagattctaccctaccagaactttgtaatgctctcacagtgtcatatagcagattaccttctggtcttaattttcttaatgaatctgatagttcatctgagaatttcacctctaaattgtcttccatgacggaatgtttagtaccaagcttatgcttcttgttctttttaacttttccggctgtagagaccggatttgggacggtggattccacttcctgctgaatttcctctaatttttcaagtttgagaaccttttccttcaatttctttaattcttgctgaagtttgactttttcttcgtgtcttctttgtttatttctctgatatttcgttttctttttattcttagttgctggattcagagacaacttagtctcttctccctcttctgaaaggtctttatcatcaagttctgattcattttcttcttctgaatcggagtcctcttcctccttatcttcaatagtatccatcaagtgttgaattcgttgtttatattgttctaaagctatcctgcgctgttcatttatcagctcaccctcatattcagtacttataagagcctcccattcttctttgcttggattatatgactttcctgcatgtggaatgacatctctttctttgacaatttctggcacgcgagcaatggaatccggcttaacagttgcgacggaccaactagttgtagactgttttaagaatccatttggaagtttctctacttcttctggtgctatcttaagcttcagtccagatggtactttaacctccttaccagcatcttcgccccataaatcaagggatcctgacttcacaagaccttcttttgcaactcttgctttcaacttactttcaccaatttttttaccagctaaagcaagtaatctgtccagttctttctttgataccccttggatcttatcatgtttcttgttagcagtctttgggttggttagagcaggcactttggatttagacttgatagactccaaaatctcggttgacttcagagttttcttgattgctttcctcttcactaatttctgctttaaaacttggtcaccctcagtatcaaccgcaaaaagcgcatcatcgctaagttctgtcaaattctgcttaccatgagtagtctcaaggatctgcttctcttcgagcttgcgttccacatcgcttatatcaatattctttctccatgccttcttacctttacgagaagattgtttgtactgagctggtctgtccttagatcccgccataactaactattttgtctgtttgtttgaggtggattgtcctgaatagtatggtaaggattagtaaaacgatacgccagtccccgagtattaattgtgtacttgaattcatctcatcgcatcgcatctcatctctttttttttttttcatcttattggcatcggattgtctaaatgaaaaattgacataaaaaaaaagaaatatgattattctccgggtaacattcactttcgaagcaaagtaaaggatatcgattcataatagacaaggagatagctgtcgaatgtcaattaggagaggaatagtctagaatcgtgtgatattgataagtaacatctgtaattgataaaataaatgattcttcaatcgaattatatgctatatatttgaacggatgtctgaaaaaatattactgtattgttagcctactccgtgtgggagcttccttcatgttctttcggcacctctacttctgtttctgtactttctattgttttaagctctgttggttcagattcaagcgctttttccttttgagcctcagcgtcagcatctggttcttcaacttcttcctcaagtttttgtttcttcgaaacagcttgttcttcttcattcccgtcagcctctggactatcgtgtcttctctttagtgaatcattatcttgatcatcaggcgaagttgttttatcattttttccattttccagagtttctctttgactttttatcttcgcttgaagtagatctttcctttcttgttccttgtctttgaaaaactgttcagcctcggcgacttgttcggaatgtttcttcttttttgactctattctttcggctagccgtcttttcttagattcgatatcattcctaatgagttcttcattggcgaaccccgccagagtagttttttcgctgaccttattaaactcaaacaagtatttcggcctcaaagatcttagattctgccattgttttactatgacattatcagtagtggtttcatcaccatcagttttttcagttttatccttgtattcggatattatagtgtcatatagttctgagggatcttgtctattgttttctgaatactttctcgctaaatctaagcctgattgcactttccatagaccgtctaatttcttattgccgagtttaatccatccgaatttcttgaatgcattattagctgttggtacggtaatcaaatcagaggaccaatgaatgtctttcaaatttgagaaatcaccgactttttgattgagtgcatccaattcattctgagctagatgattcaacaattcataaaattgacgatccctaatttcataaaatgaagaaattctgtttaacttcttcgttaagaaattgatagcagaatcgtttttatttagcacgttgtctccatattcaacacgccatttcgatgaatgggacaatgaactctgattaaagattttgccatagtagtgaaccaatgtatcattggaaataatttccttcaataagtaaaaagtcaaataaacttgcgatatgaccaatttcctgaaatagtcatattcatatgcttcaatccgatcctgaaaagatctaagatcaaataagtctaattctaacggtagcaattggatgatattttctgacttcgtagattctaaattgaattccttccagaactcaactttggatgggaaaattgaatttcttgagtcatctggttcatcgtaaacgttatcgataaagtttaaagggtagaaatctttaccattaaccgcagcttcttgtttagcatgcttttcattttttccttttatcaaattgtatagttcggtttcatagacaaagatctcatcaacaaatcgatgaacgacaggttcgagtgtgagtttgtcccttggatgagagaatagccaatgcaatggatgaaggaagaaatcatcacaaattttcgtccaatcagagagaatagtaggagatgaaggcaaagccggtaagtgtggagcccaaaacgtttcaggatattcatccgtaatttttgcccttcgattaatattgcaatggtcattaataggtattagctgcgatatccaccataataatttatgcacaagctcgaaatgattaggtgtgatgaagagagaatgagaatcgatgttcttgaaaaaagtatcaatgctgaagaaaagttttgcagctggaggccttattcccattttcaagtttgttcctccattagatacaggttccttcgataggccttctaagtaccatgacaatcttgatcttaggtacgtatagaattgccccagttcatgcgggaaggttaatgtcaggatacaagttgcagttaggtcaaagaataatgcggcccataccttagattcatcctcctccccaacgtactttaaatgataacaaaagtccagtaagacgcttagtttgcgcatgtctgtgtctccagcatttgtcaccaattcgtttaacagccctttcaatagtaactctcttttacctaatgatagttccgtatctaaagaaaaagagctggatagcacaccttcagaaatgttctcacgtttcaaaggttcagacagcacattttcagggattggtctttctgggtcttcatacaacttaatctgcaattgatccacaatttcggcaagtgagctctcgagatcttccatcttacttttaggttatcaatctgcttcaaccaattcttgaataatagctgttctctagaggaaaaacaagataataacgctagctcgattgactccacgaactataaggttttcctcccaaaatagttggaagaccacattgtagctatagctattcagtaggctttaccaatgtcaaaatttcataacagttgctgaaatttgtatatcacgtgaccaagtttttgaacgtgaaatgttagacctttaatattatcaggaactgggaatatgatgctttaagagacactggaatgttaaacgaccaacactgtactgtttcattgggttttttgcacagctgagccatacagaactaaccagaagtaccaattccttgcattatatattggacgttcgaaggacatgaataacaacgttgtgtttgggtgtggtctggtagactttcatcatactcgagggccagagatagaatattggtacgacggtggaacaacagcgttgaatgttaataatttatgggaatatttacccttccaggcccttccagatggtgcgcattcttacgaacagagttttacatattttaccttgctttatgatgaagtgaataaaaaatgttgttctagtgtgggagattccctaaaagatggtgaccaaagtggacgatatagtacgttttttgcgataagttgctccaaacaaattcagagtgatactttgataaagaaaccgaaagatgtcatacggtccactgttcagaagtcccttgtagtagtctgcaggaaaccaattttgggacagattaaagacaaattggcaataattaccaatgcgttgtttatgcaaagagatttcacagataagacgattatagacacattatattctaacttgaactcaattgagtatgatgatcatgatgaaagccatctttatgttgggttaaatttaagaaagaccgtgtatgatctacggaaggaagtattagttattttgaaagccatattgctagagaagaaggttttgttctatggaaatgacgtggaacaactttgtaacattcaatttgcgtttatcagtttaataccgtgtttgctcagtaatattcaagactgcggctctcctatgcttgacacatattctaaaaatatgaccatggtaaattcattcaaatcaagcgatagaggatctgtattacgatttttaggcttcccgttgcaaatattcacaaaaggaggatttttttctccgtatgtccctctacaacagatgaacgacttaacggcctcggtcacaaagtggtttgttgcaggaacttctaatacacttctcttggagcaaagcaaaaccctatgcgatcttcttgtcaatatagatgattccactgttcaaattatgaacaaaaaggataaagatttgcatcaagcattgcaattgagtcaaagtgataaaaaatggatggatgtcgtcatccaatctgtactgaagagttggaaccaagacgactactctacgttgagaaattcgcaatttgaaggaagcgaggactatattcgttggcaatttgaggactacctttcagggttagttctaacagtaaaattactggaattcacgaagaaatataaaaacaatgccgctctactcaaaactgtggacgatttagccactacggaacagactattaatcagtacaactctacttgggttcgtgattggcaacacacaaataattatagaatcttcaaacagtatactgatgatcgcttattcgatgttttcgacagcagacatccctatagaggatcggatgccatggcggttgtacagcaaaggttcaacaagatattctctcgaaaggagaagggagaggacaagagcagagaaaggcacccggaaggtgaaattgtcaataaaggaggcatgaaagaccacaaccgagggaattggttcaagaaaaaggaaaaaaaaggctatcaaaatgatggtcctgagagcattgcaacgactgatccgttgatcttatctaaagatgatactcaaccgaccgtggccgacattccaggtgagataacggaaaacccatggaggtagaaaccttggaacatttctcgtgtaacttttatttaaaggcaagtgaatatataaagtatttacaagcttctggttcaattcatttcttttggtcttgttactggggcttttaccagcctgctagctgtttttctgtaggcaaaactgtaaggggcacgtgaaatacgaaatcgtatccctccatgtctcttttggcatggtatagggtaccttttcggtcctcataggttttactcaatgatatttcagtgttttgctcagctaatggaatcatgacaaatttaaatgttagcatccatttaagttgaaatatgtttgttttaaattgactagtaatgtaagtcgtgggagagcattgaggaataagtttcatgcaaatcttatcgcaattatcgaaatttgtagcgtgagtttcgtagactaaagttcccgaaggcttcttctttgagatattttcatctgacgagaattttggattaatcaactcaaatgtttcgatggatgctgtcacagcagtcactttaaaattggaattatcttctacatttttcaagtcaagtattatatcgatttgatcggaaacagagtacgctggtttggagagttctaaattacaaatgaacttatcattcatttttacaacatactcagtttgtaatgactgcaactgcgatagtagcgaagaattgctttgcgtctcatcaatagagttctctgggatacctgtaaaataaaattgcgacaagttcattcggactgaggttgagggttctgtttcaaattgttggcctaataatgaatcaatgggtacgtcggaatcatcattttcattccattctgagactacgtctttaaacttttgtttcatggcttcaatcgaagttcctgaaggtttcccgatacttgacacgctctttcttcttatttctctatctaactggatggattggcctgttaatttcctgggttttgtagattttatagtactcccaacatcttgaacttttcccggtggtgtgatgagtacttctctatcaagtggcatctcatattggcatatactcttatcaacaaacggttgtacagaaatagggaagttgtaaaagtgttggtgagggatatcttctggagcattcaccgaaagtcccacctgtacgacatatgatatattgaaatgagcagagttcgtataagaaggcggaagatctttccctaattggtccgtcttgaacttgaataacctagtttcgcccggccctaaaatcaattcggagaataaaagcgtctgtggtataagtaagaatggcgcttttatccaatcaccggtatcgatggtctccgtagacatcaaaggggccaccttccgtgatatttcgtccatgctcgtatcgaagaaagatgaaatgacggtagacattggggaattttcatcagtacttgcgtttttggaaccaattcctaccaattgatgaacattggatcctgtgtttagcatatctgtatttattattgcctcatccatagaacactgtccgacgatttgcacgaagcaagacattagatccacgggattatggaactgcaatttcttcttcaaagcaaaaatttgttcctgcaaagcttcatctttatacttgtcttcttgctggaaagtattccataaagtcctcattaaccatggcttggactcgtcattattcagattggccaaaaacttatcccttttttcctcaaacacgacaagtttcttctctaaagattctttctgatgttgtgagcccaaatgctttaaccttatcaataaacatatcggttcgccagcgaaacaaggattagattcgtgaatgatttccagtcgaatattccctccaacaacagcacggtcccttctatgaagatgcattgaatccaaaattagcaagtctcgaacaagaaaaaagagcacaatcgccttctatgactattgaatatgttgaatcgtatgttactacttcagccccttttatcagtgtattctcaaacacataaactattttcatctctttcttacttctatacaatgtttatgattgacaaaatcagcatctgaacctttaaattttgatctcaaaactggtttgaaataagtacacagatttccatattaaaggcaaaagataaatgaaatagataaagaccaaaaaagtatattactttacctcttgagatgggtgttttttgttcccaccctgaaacccttcttaagtaacagccgattgtagaaggaacaaaatgtagttagtacagcgggttcctagaaatagaaaggtctaatctggaaaaaagtaaaaaaataatgatacgaaatcttccccgccaggactcgaacctggaatcttctggtttcagaagtagctaacatcgtagccagacgccgtgaccattgggccacgaggaataagaaaacgcaatgattaattcatgtaaattttggcctaagtaataatgatagtcacatggactgattcctgcctagaaatggtttgggaaaccaagtttagaacctcaagttttggaatcatcgtaatgcaaaccaattctcaaaaaccgaattttggtcttatacagcggttgaggttccaaggaaagcaccgcctacattcttttgaaatagtcagcctattagttagcctgaattggacagttatcctttaatacctcgtggtggtaggacttcattagcaacattgtggaaataaccaatacagaaatgttactaagtgagaatattaaggaattacttcaggagacaataaaacctgtacaattactcgagggaagcacgcctcctcagtatacctcgatgattataaccagtaaaggcagtattctatggtacgtgaacggaacaacgccagaaagctacaattcctctctaacaaaccttaaaatgatggccttgttgatcaaggataaatggtgcgaagaccaagatttaacggccactgatacaattcaccattttgaactggaagatctacatatagcactggcaagaatccctgatagtgaacttttgctagttcttattgctggaaatgagtttccaaacgggcttttgggactgaaattaaaatacgctttgccagcattccatgatttaaaaggatacaaactttcaagctaattgatactacaaggtgttattatactcacttcgcatagagaaaatagatgatgtactccatgtaacgatatatatatatctccagttattgaatgagatatgcatagatggtgctttaccctaatgaactgtgttacccggatactattcgaaataaattcgcgaaaattgacaaggcctttaaaattgtatggaaaatatgattgcctaaacattatatgctttatttaacgtgatgctattcgattggattttaaaagctaagtaggtcaagaccaggactgctgagcgctggcttattgaagcgtaacttcaagtggaatagccatttctggaagcacctttgaaagcgaagcgatctataggctcttccatcaaaaattctgcgaattgaatccgttcgcttgattcaccaatattattctgcatacaacatacctttttaattcacaaaaattattggcagaaagttgcaattataccaacgttcaggttttattatcaagttcaagctatcactttttggttgaccgagtgctaatcaggaattcgaaagcaactagcaatctacgcgcataaagcatcattcgatagcatctggaagatggcaaaaaatacacggtctcctttgaaggagagtaaccctaacaccatgggtaatcacatacataatccgaagaagcggtcacttgatttattagaattggaacagtcgaaccgacagaaacagagaacactgaggaccatagagggagccattgcacatgcaccaaacgcattactgaaaactgttcaaggcggaactacaaacacatttaatatcaatgctactggtgttaaatcaggagcacatgttggagttaatgaccctgtggcagcttctgtttctgcttcagtgtcagcgggcggttcaatgatgcgcaacagtaatgaacacggaataatcggcggtaacggatcgcctgcaattgctaacgctaaggcccagacgcagcgtttgagtaataaggaattgatagactggcagaataactggaagaagatcatgaaacgcgatacttttatatatttcgattgtcctgaggtagctaatgacaatcgtaaggatgtactgcgtcgagcattctctactttgggtgcgaaggtaaaacaattctttgatcatgaagtaacaattgtaataacctcgagaaagataacgaattactctcaattaccagatacagatatacttcaaagggctcataagcgcggatatatgaaaatatggaccttagagaaggccgctaggtttttgacgaatatggatgttgacttgaaagaaatggaacgcgacagtattagtgggaaaagcattccagcgtccaatttactgaatttattagaaagtgaaaagctctttggtagtaatgagagagatccaaaaactaaaagagacgatttgcattacttcaagcatccacacgtatacttgtacgatttagcacagataaatgcaccattgatcacattagaatggaaagctcaagatatcaataataagaagaaacatatatatccaaccatcaagcctggatcgtttggaagatgtccattccaaggagacgaaactgcagatgaattgcaaccacgcaggataatcaaacgatacaagagagataaagctaatgagtcgtatgctatgaagctaaggctcctataccagacaagtgcagaaccagccacattgtcctcttctgaaactagtgattatgaaggtgacgatgcaatattatcattccctgatccttcttcaaaagaacctatcatacttccgtaccagaacgtttacaataattctggagctcaatataataagttggtgaactcaatgtccagattcaaacagccaaaactaccaagaggggatacgtttgatgatgatgaattaccatatgggaatggtactggcaccataggtggaacaggtagttacaagaacaaatttcaacaggagattcgggccagtggtgtacaatcagttgatgccaacagtaatggcaacgctacagttggtaatggattagagcctgctaaggcctctaatttaaataaagatcttctctcattgaaaaaaatggttatcgaaagaaaatcactactcagtgccagtactacttccacttccgctaatactgtcggatccgttaattctggcaaacttcacaatcacaatattgcagcatctggtgtaaatcaaacaaatccgacttctacggtaagcaaacagcaactacccgcattaacaccacaacgtttacaccagccaattggtaggcaaactgctggatattgtgaaaattgtaaagtcaaatacgactctttagaagcgcatgttagcactgagaggcatatagcatttgcaagtaaggatgaacacttccaaggcgttgattctatgatacagtgcgttcagcaattcagagatattaattctgcataggctttacttcatttcaattcagttcatattcatattatatcggcaccgcttattaaatagtacaccacatacctacttcatatttttattgcatacaatcgaaaaatcgttaaataacgtctttccgtgactagaatttataactcggtttgaaatgaaactattcgacatctggtccatgggcagtagttaatactgtcactactaacacaacaggttccaaaaaattacctacccgtcccagctgtaacgtctagaaagtacaatcatgcacaggtatgtttaaaagaaaacgcatttctctgttaggcatgtttgaagacaaaaaatattcaccggataagatttctgacattcttcgtaaggtgggcagtatacaggcaatgccgaacacttttcctgttgttcgtttctatgcgaaaaagtcggatgattgagaaaaaatacttcaacaatcttagttaattagatttcggcgatgcttccttatgtggggtcatctggaagacacttgcaacagttcgagggtaaaaaagcggggtagctacgttgctctctaaacggaaattggggtcacaggatcatcagtgaacttaccgctaattaacaggctggaactgcgattacgtctacgatcgagagttgagactaaaaatgggctaagttccatttccgatgtatgcttagcggttctcactgcgtacttgctgaaaaggccgtagagaagacaaaacggaaaagagactgaaacagtgagacttcacagtcataaaataatcagagtgtcttaaggaataggacatgagaatcgcatcaagtgaatcaagaatcgtatgatttgaggtatagtttttatgcttgccttctttctgttccgaagccgccgttctaactgcaattcgaatcttgaaattatctttttcctattgtcatgcataatcttactttcataatttagaactcgaaaaagactttggttttagaatgtttattctacatcagttagataatagtgaaagcgtacaccttcctccaatcgcctaaacaaagggcactaaagctgtgatgtatattcgaatatttattttctagatatttgcttgagcgtagtctatatttgaatggaattattactacagaaaaaaaaaaaggtttataggaagaataagacgagttgaagcgaagagcttagttgaatagtcaagtctgtaatgatacgaaacggggaatggaaacggaaaaataaaagtttgagacagaaatgaagactaatccgtaaaaaaaaaaaatatagagctttcaaagcaaagcatccatcgagaaaagaataaagaatcgttaaaaacatcgagctgttgggcaaagaaattgtacatgataaaaagaattgaaagtgaaaggggaacgagaaggataacaacaaaagataatagtagaatgcaaataaccggtaacagctcaaaagctctttggtgatcttgttctagattttgcttttacctttggggttttaagatgcaatttataatgccttaacatattagatttagcgttgaattgtttataacagtttggataaagacatttgtaaggtttgtcccctgtatgaatgttcatatgcgtgcttaaagagcttggtcttgcaaaagccttaccacattctgcacatctatacttggaattagcagttgaatttgaagtggatgtaagcgatgacacagaggacgatgacgaggaacgcatcgaggcaccatagtggttgttttgttcatgaatagaagggcacgtcgataacgactgtttcatgccttgaggtgctgtatcttccagcatagggaatattgagggggaagcaatattgaaggctccttcaaaacttgacatggagttagctctttcagcaaactccgagtccatttcggattcagtgacagagtctgaaacagagccggccaccgattctgtcactgaattaccgctccttgcatttacatttgtcgtatgagtgcgtttaggtggatgacatagttgaatgttagtaccgacttgttgaagctcgctactttgcgacggacgctgagatgaaggctgcggtatgttctgagggtaatgttggttaagaggataggcaatgtgattggtttgccatacgtttccaaattggttttcgtagtttgggtcccatagggacgcagcgacagattcgtcactgttatgatcggtgccagcacctacacatgtatccgtatgattgtgatgatgattgtggtaatgattgtggttattttgatgatgatgatgatattgagatttatcatcataaggcatatcaggcccgccatcatcggggacccaggcaggcgcagagaatactgacgcaaaagtagagaagtgaaatttcaaagacggtttggtcagtttatacatctccagtgccggattcgtcgagggaagactcgattcgttcatcatcgatgcaaatacatctagaggtacggaatccctccgcatcagtttcttttcgtgactattatcgttgtaattatactttgtttttgcatcacctaagttgtatgtcatcataggttttccaatatgaaaggaagaacagtgcaagaatataaacagaaagatgatcgcttagtttgtacgatggtgtcttggaaagaaaagagatgttgatcttatgggtatcaaatcgagaataaataaaccttttccttatattattgttggcaattgcggatataagcgtttgtaacagagactttaattgattaaaacaccatcaacactatcatatgtcaaatggaagctaatgggttaaatcaaagccaagcaaattaggttgacaaagtatcgttaagataatataaagcttgacagataacttgatcagaggtcagactgttcagtactaattcggtctttgttaatctagctcatcgacttttaatattttcatacatatatataaaaatatacgtatgctatatataataacaaagtaacaagcaaaaccccaagcccaaacccacggacaggaatagggcccttacttcgtgcagaaggaacggaaaacttaaaaagattcatagttgaatatataacaaattgaaatctgtattccagacatggaatctgcgtaatgtctgagatcgctcgcagtctgcagaaagccagaattgaaaattggtattaagcaaaaagaaatatagtgaaagtaccggtggagaacgaaaagaagctaaggtagagaagtagaagtagctaaacaagatagtcgaaagctctgacaaaacgatgatgatgggtcagaaacggagacgtctaggaaaagatgagattcggccggtaattgctcaagcttgggacgttacctcatccagacagaagagagaaaggcattagcacggtctcttggtgatattttcagaaaaaaaatccgccgctagaatatactgcctactagatcgagcatgagaaatgaaacacatttagaagaagaagaacaagaaaaggaagtaaattaaattctagatggacgacgggttcgaatggaccggacagtgggtaagtatgtcaggcagcgtggcagcagtcagtacgggataaattatgataccgaagaatgtactgtgtagtaacaactgggcaggaggaataataacaagggaaaaaaattaggaaaacagagaaagaaaatccgctggctggcttacatgcccaggatgaaggttggcctgctgtaatattactttagtttatgtcacgttacgccatggccaattgacctgcgacaatgtcaatacagataaggagtgtttacccttaacgtgaagtctttcatgtgcctgttcttttcacagtaatcaaaagactgagatgtcttgatttagatagcagtgaagagcggatcgacatagcgcattagatagcatttgggagatcagttgaagttgcaatcgatcagatagaaatccagtttcctttaaatcccacagtcaattccaaccctagatttttcagtagtgcagagtcatctaatgaaacctttctttctttctttctttctacgtttccgcttccattcgtagctcaccttggatctcattcaatcctccagatttcaattctgctagtaagtaaacagagaagtaattttaaacggtacaagtactctatcaagacgcttccatcatgcttggccgagttatccgcagatgaagaaagagtaaagaaaagagaaacgatcgtagaaatactgctcgaaagtgagagctgcggatgtttattgtttattggcggtttcgcgagcttttctaacacagtcaagggaatgcggaggaatgggaaaatagggaaaaacatctgatcttttcttggaacattctttcacttgaaaaacacactggcccgttgtgttgttgcatgttattgaggtaaattacagaaggaaactaaaacacaaaatgaaggtttcgaatctacaaagaaagctcgtagagacaaaagtacgggcatttctagaagcacagaaaaagaagtatacggttcgacgtactgttcttttttgtggaagatgcaattattcatttccattgacgatttgtctctaagagattacacatatacagttgtgcagaggatacaaacacgtggaaaatggtgacctcttttgtttagtttttgagaaatactgcagtaggaactctaaagacaaacgggtggggagtgggggggagggggagggaacagtgataaaaaagggcgaacaactgttagatttggttgtcggagttctagtttcgttcgttaaaaatccatgtaaaaggcaaacgagttgcctattgaatcaatgcacaatttcaaaagcccaaaagaaaaaaatgaatcactattctgtaaagagaaaacaaaacgaatctttgcgagataggaagaaaatatagaaggaaagaattcaagaaatcgtcgtagaatctatcgtgtggaaaaaagttggaatctacgtctccattttccaccgctgttgctgtctttgctaaggtaacaacagccagggaatattgtttctgaaacaataatggtgttattttttgtgtcaattggcaatcgtaatctagaacctgaaagatcgcattacgcagtggcaattataatggactcgatgccgtaggttcacaccatttgaagctcatcgtttcggcgaagattggggtgttctcccttaaatgaaggctaatctcagaaagaaggtaactgttccgaaacagccatcaacaaaaaaaagaaaaaaaacaacaacaataaattgttcaatttctaccacacgaatgtcttgacgtgtctcttcatattcggcataatcctgtttcggtatgtcccgttggttcctgtagttttctactgccaaatttcgttcgagggatattctaaatttttttctttctcgacgctccgctgtttatgagcacaggaaaaaatactatctgaaagaaaaacagatgcaatacccggactttagccatcatcacatttacctgcatagcacgtagacgcgtaaacgttggcttgtctatggataataaaaaaacaaaaaactttaagcgtagtaatcaacgggtattggacgttgcatcatatgattttcctattgcagcaacggtacgtgtatattcttatgcatactatgatgcaatgtatggtaataacatcgttacctcttttcgaagtttaccattccttctcgatgattcatttattactaagtgataattgctcattaccgcgcagataagttccacatacgaaaaatatgaagcgggtttaaaaaagaaggtaaatccaagaaaaagaaaaagaagatggaacagttatatgagattctactaaatgtaccttagttgctatcgttatgctagacgctttggaaccgaaatcaagaaccatgggaaagaagtagaccatagacacttacggagtgtactcacatgtttagcaattaactaatttttttctggaaccgttgtccacattcgtgcgcaacttgcagttgcatttaaaaattcttcattcattccggcaaatttcaggcaacaattaaactttagtatgattaacgttatcgtaactgtttgctcataatcgaaacaattgattaatgatctgctgccctaagaaggaatgcatctccgatagtactttctatcgctaattaatgatgcggattttaggtatgattattttaccgaatgtcttacttcagggtgataacactaccctatacacgtttttttgtttacatgtgccctttgtcgtttgtttatctacgagtttgtttgcttctgttcgagctttgtcgcatagattgcaaatataaaacttttgtcaagttataagtgggagcccaaacggcaattatgtggcattacccgaacatctcctggcaataagtacaatcattcattcattaatcaaacagggtaagttgttttcttgtgcactctaaaatttttggtttttgctgcgagcttatgctgggttcattaaattaaggtttttcaatttttttttttttttaaattttgatcgctcgaatgttgctgaacttttaaattcatggaagcgtgccactcaaagcttcgtggaatggtcgagagtgaacattggtttttgtaatgctgcactccaattattgaatcgatctatcccttccatgttcgtgttggttcctgatatggttgaattcttttgtattgtacctggcatcacagtgattgtttactttccgcgattgtttcctagtaactagtacctgacaattacctgatttggaaatgatatgagaaaagccgttaccttaaattatatgttggttttccagcattcaataatggtccggttttctctataatgaagcaatgcttgtgcttggtgcatgaaattgatattgatattaccaactccaaactttaaagtggtacctgatttttatacgtatggtaggatgataatactacccagcggtaataatgactattaacatatgcagaaatgatcaggaaactagcatgatatttgttgttcagtaaacgatgctgtgacatctgtaacctatcaagcgagtaagttgcatataaaaaggcttcatgatgtgataccttcaggacctggtgctaggtatgtttcatgtcacataactttattatttgaagctttttgttttagtattcttgtcctctccccaatcaacagataccaatacatacacaaatcttctacctcagcctctagtatcctgaaattatcatgcttcatcagttttgggttttggcagctgcctttacactatcgtcatcagcatttgctgatgactatgaatcatccactacgcgaactttattccccaccaatatcagcggtattgatccaattgctaaacaaagagatgttttgtatactgaaccagaggaaaacaccatcactgttggcgaagtttaccaaaatgtggctgctgtttctgtagcctcttccacgaaacccacccgtgtttctgctactagcgttcaggtgacttcacttggtacttccaccgtaataattgacctgtcaaaagaggcaactagtgtttacgaagtttccccatcgcaagagtctgctatcgtttcaagcgtcactcagcccgaagagtcaaccattgtttctgatgtttctgatgtttctgaagacgcgacatacttttcatctaccagcaacaacgttacttcacaaataccggttactgaaaaatatacggaaacaaaacctacgtccacatctgtgatcttttctacttcaaccacagctgatccttctgtaaccaaaggtacaacacttactaccattgagtcgaaatctcaacctctagttactcaatctatggtctcatcggagcaaacagtaacccttgaaaccagcactctatcatcggaccaaactttcagtcctacgggaatcactaccacagaaacaacctctctctccacctacacatcgactgttacttctacttttgtttccagctcgtattcaatggtgtcctctttctatggaaatacaacgatgctttcttacacagctattccagttaactacacgacaacgcaaaaattcacctccacgtcagttacccaagttccaactgcggttctaaccgattcttctacaatcgtcgaccttttcgccgcagttgccacaagtgagccattatcggttttcgcccgtgtggaaaacccattggatctggcagctggtgttgataacggtggcttaccttatgaaaccaacaagttctacggtaacttcatcgtgggaactcaagaatcaagtgtctttgtttacccatatgttcttttcaagacttccctaggtattgctattcagcacaccagcgcttctcaatatagctttactgacagaaactctttaattaacccattgaacatcgcctctttcgttgtttctagcgcagaattccagtctgattctggtgacatgaactttaaagtgagtgatatgtaccacggcagttgtaatgtcaagttagtatcctccgaagatgcctccaactacatcgaaactcctcttgttcaaggtatggggttcgttacttctgtattccatggtgatttgaccccatacctgacatcggctgtgggtatctccactttgacccaggaaacttctgacaatttggctagtggcattttgaaataccgcgtaacactattgaatggtgtcgattggttaatctatgttactgttccagattccatttcttctgatgaacttacattaagtattgaaaatggtaacattgccttcagcacaaatgacggtagctcaattgatggtctaattgttcaaattgccgaggctccatctgcttcagactcagaaacatactacgactctgcagctggtatgtacttcaccagtatggaattagcaggtacaagtgatggtaataccgctggctacaaatttgtgtatggcaccgaaggtaaatccattagtggcgctacgatgctatttaccttgccacatcatctaaactctttaactgaaactactatggctgctaacactggtattcagctcgactccaccaccaagggtaaaatgacaggatttttgactacctccctagagttccaaactcaattgaatgctaatgtcaactggctaccatggtcagaacaaaagggcgatgatcaattggtctacacaagtgaacagctacaattattggcaaaggtcgctaatgaagagttacaggttagcattaaagattctattcagggcttaaacacatattacatcggtaaagtcttggacaaatatgctttcatcttgttgactttgagtgatattattcaagatgaaactgtaacattggaaaccttgacctcaatgaaggaggcgttcgcgttacttgttgctaatcaacaattgtacccattggactacgacaccaaatatggtggtatcatctccagtggagatttaggatctactgaaacacagtatgacttcggtaatacatattacaatgatcatcatttccattatggttatatcatccatgcagcagcagtggttgctcatgtggacaaaaaatatgccgctggtgactgggttgaagcaaataaggactgggtttcagctttgattcgtgatgtttgcaatccatctttagatgactcatacttcccacaatttagaatgttcgactggttccacggccactcatgggccgcaggtttgtttgaaaatggtaacggtaaaaacgaagaatcttcaagtgaagattatcatttcgcttatggtatgaaattatggggtgaagttaccgaaaacgattccatgaacagattaggttctctgatgttgaacgtgctaagagacagtatgcaggactactttttatacgaggactctaacactgtcgaaccaggccaaactgtttctaacaaggttagtggtatcttattcgacaacatcatcgattacaccacctatttcggcttgaacacagagtacatccatgggattcaaatgttgccattgactgcagcctccggactgattagatcaacaaaattcgtacaacaagagtgggaacagaaattaggacccatcattgatagcgtacaatccggatggacaggtatactaaggttgaatcaagcattgtatgacgctgctacatcatatgagtttttcgctcaagacgatttccaaacgtcattataccttgataacggtatgagtaggacttgggcattggcattcgcaggcggattacaataaaaaaatatcaaccacaatacgatttcccactaacacaaaggtggaccctatgtttctcatctttttcatgaattttcaacgctttaattttcttcatagtttgttaggtatatgccctttatagatcaaatattgtaatactactatcaataacacaagtcaaaagaaaagcttagacagcagaacgtactacttccagctattagatggatctacaaatgacgaattggtgacaataatagataaaaaaaaacaaaaaaacaatgatcagctgaatacaaacatactgttaccaaaagataaattgcaatagttgttgccttcgcagtctattgcctgtgtgacactctctgccacatgtgataagcacaataattcctctttttctttttctggtacacctgttaatttgagaaaaaatacgcatgatgatgcgcgatgcagattcggataaacttgaaaaaaaaagaaaatgccctccagaaattgacccagtgtgtatcatgtccctgcatgtatgtacttctaaagaatcatgccgtagttctttcttgtttttttcttatgttttttttatcgtgagaaatattgaaatgtcccccttctatcaacttatagaacgctatatttcagcagttgccgtggttgtgctgttctcaattcaaggctcgaggcgttttggagcggaaagtttttgcattttcgttgcccttttcaaaaagagggcctacgcatcatggaaaatcacaggcaacatatatcctactattaactgagtaaacagacgtaccaatcagtccggaaaagctagtccgtattatctacaaggttcttttcccagcacctacctttagccatgtcaacgccagcaaataggggaaaaacatataaccctctcttaaaaaaataccattcgagtgcttttccgtattcaaacagccaggcccctaaaaccgaagaaaacagacgaaataaaaaaaaaaaataatcaaatatatagaaaaagttgtgtccctccatttatagtctagtaatctcgtggaggatctaattcgggtgccgtgactgtcagtttctatctccacccaaaactcctggatacatttaggcgaggttattagccctggtgctgagacgcggatttctgattctgattctgattctgacttctcaaccttttccgtcaggcgttacaaaaaaagggtacgcaaatgcactgcggcgcaacgtcttccccattccgcttttattccaaccattaacaaggcaacaagaatagtatgatttctttttcaactacaaaaaccaaaaagctttcttctatcggtttttgcgcagaaagcccgtagcatatttcccacctcgcccctcagggccaagggatccataggatccacatagcatctaagtagctgcggaatgccagtcttttcggctcaaagaccccactgaataaagaacggaaataaaaatccaaagaacggaatagaacagtttttttctctcccttacaaggacacaaaaacgaaagcttctcacagaataaagcgcagagcaatattacaatcgcgtcagaatcgaaaataaaaaaaaccggcttcataaatcctatgcgcattcaaaacgacaatagctaggtggtttctttttttaacttaggtgttcagtatttccgttttgcataattctatgccatggttacgatccttttttcctagtgcaggcagtagcttgcagatattctattttggtttgcttttggatcataaatctgttgattacattatatacatgcagacttgtggtggttgtacattccattacttcgcagattattcctctttatttacttattccctctagcatgtcttttttttttcctggtttttttctacgtttttgttctcggccatttcccggtaactatcgttgcctctggctcctttgtcatgaattcagatttgttcatcaaccttatcttgggttcttgtgtgcactttcgttttattgtaattttgttttttatttcactaatttccctttgctctatgttcttcttgcagttctcaatttcatttcttctttctacttgtacctatctcgttaccattcagtgggaaacgaactctcaaactaagtactcatctaaggtacggtcaaactatacagatagtgatatcgattgctccagagtgtgcatcctttccttcccttgtttcgtgctataaactagaagaaattagtgagaccaaaaaccaaaaaatcaaaacaagaaccaaagaatacgtacattattaccttactaattccaagattcaaatcgcagaggctgtgaattttttgtactgctattttctcttcacactttgtattcctgattctgcgtttcgtcattatagtttaactcacaaccagtgtgtgttttattttcggtttcccattctttccgttctgaaatttcggtttgcatttattcaacttctgaatagagaaagtatttgcataccctataatcgaacttgagtcagttttaagttcacgaactacagaagaaaaaagattaaagtaacttcggcactccaattgcgctttgtacatctgcaacttttgatacggcctgaaacactaatctgagctgtcctttttttttttttttttctttcctttatgtccgcgatgcatactccgttgaataccactttagatcaggttgggttactatgcggtaggaccgctacctcgatggggttaatccatattgcttatgatactctttccaggctcttgcaaaggaatcctcaaaatggaacttgtcttttactactctgtgagaactattggaaacaaaaccaacaacaacaggagtcaaatcatgctatagtaatagatctgttgaccaaatcgttacagcatgattcggctacttcgccgttggttcgttcgagtaatatcaatgataacaatggtgatgccagtaataacactaataatggtaacaatattaacaataacaataataatagtaataacagtaacaataataacactaatagcattagtaccaatattaagggaaaaagtgacaacgataactcattagcaaggcagggacccggatctttatcctccaattatttgatttggacttatttggcaattgcatgtcttcacaccaatcagatcagcctagctttgaaaagcatcactcaggctacttcgttaaatccagatgaaccatttctttggactttacagacaagaatcatttcaaggtggtatttcctgttagccttggatccacaaattcaacagcaacaaggggcgttgcccactatagaaactttgctaccttattacatcaacagcatcgaatggtctactgtgaaacgggatcctctcatgcaattggaatcgcatatctcgttagctaccttatatttccagttctctctcttcgagcaatcccttggtgagatgtcgtttgctctaaacttattggattcaattcaaacttcgatatctttaaatgaaaaccttgctaagttgacatttatttacaatttcatcgctatcttgcaccaacgcttaaatgacccagataacgcgttgcagtttttgcaccaggtgaaggatttagcgccaactgaatctcatgtcatcagatgttgtatcactatgtccggaatatcacttctatcgaataatgatctgaaaattgagaactcaatctcattgttaactacggaattaaacaccttaaccaagttgaaatcaacaaaggacgcatactattcaatcacatctaatgaggaattcatgttgaggtatatgctagccagatgtcactctcatatgaatgacacgggaactagctattaccagttccaacaactattgaagcttttcattaaccatgactattcgcctttagtttggacttctatcgcttcgttgtatctacaactggatcaattagccgattctttacaagcatactcacaagctgtacagatggcaatggataaattgaatgatccagcaattgtaacatctacttccaatttttcaaacgtttatctctctttcaagttttacaaattgtttgctgcttacggttggttcggtatttcccaagtatattccaagacagatcagataaaagattctttgaatgccttggaacaaagtatagagctattcagatcagttggtgactttggtaccgctcaacaattgaagcaatactatgagcaagttagccaaactgcttccactatgaagaaccaaaccggaacagaccaatttctacctccagatattcctattgatctattattagacttttcagtgtatcattacatgcaatcagcattcattgtagaatctttagattctcctgcccttaacgctagaatcccaggcgttgacttgcaagtacagcctacacagtcattatcacagcaaccgcaacagttccaacaaccacagcatatgcagcaacaattaagccaggtaccactgtccgcatctcctccccagatatcaacgctacaacaacagcaaccgacacttcaacaagcaggtatgtctcagaacacatcaccagcactgccagtagtgatggttacccaaaatccaaacacacctatagaacataacattggtatgactgcagttcctcaacatatggtacaacctatcccatctcatgtccatcctcatcatgcgcagtcaatgggagtttacacactgccttacgttgttcaaaatgcagctgcatttcccgcgcagccagccgctggcggaccacctcctatgtcgttgggatatattcaacagcaacctcaaattgctcaaactcatgtatctcagtctagatttggataaactgtgaaaattataattaccaggcttttaataatttaacggtatgtaacagcttgtattaaacacacacattatcctaatgaaatgtatgtattaaaatttagccgattcatcacgtatgaaacaatcctgtaatgattattatttattatgatacacaaattaatggatttcagtgttctttttagattagttatcaatttataattcaagatatttgtgaatagttaccatcccactttctctatttgatacgatgaaagtttcaggtaagaattgtaaaagctcgttgtacgcagggattttttgtaccacctgcccattaacaatagtttcgtcaaattcaccccagtagcaatcaatggaaactccaagtgtgtctgaacttccctcagcagtatactgaggtatccacttcaattgaacatcataatatggaacattccaactgagtttgtgtaaaagcaaagaatctattccctcatcggttctgtaggaatgggttgtggtttcattgccgactttgaattcgacctgctttagatgtttcttccctgttgtattgaatttcatcaaacataatctgttgtctgcaacattgatccgtagatcagcaaaatatggttcatattcaaagtgctctttatcattatgagtgtttttaactacatctaccttcatgggaataccaaagttcggccacatgccttcatatacacacagttctgttcctgaccctgagtctttgcaagacacatttggtctggacggtaaagatgatagaacttcttgaatattagctccagctcgaccgtatatttcaacattttgttttgtttctcttgagatatctatccgttgaacaaatctgagcttaagaggggcaagctcagtatatggagcagcaaataatgaaaatgaagccgccaaaattgttacaactcccaaaataatcactacaaatcgatttaatttggtggtgaaggggagtagtggtgagcataagaatattgctccgtaaatagcaaacttgaagacagcttcagttgctttgttcgactcttggacggtcatagacaaagcgtcaaacagattgaatagactttcccatattaaaaacgcattgattggaacagccaaaagatactgagctgaccagtcataattcaacgttctttgtagatattggacagcaccaggtaggctttttgatgaagcaataggacttgattgaactgatgagcttggagtattaatgagaggagatgtctcagttgtttcggaatcttctggctgtcgtggacattctattgaatgggtatcgtttgtgtctggacgcataaactcagagttgtcataatcatttgtcgcattgggccttttaccaaagcacatggaacagagtccaaacatggaagcaagagaaataaatagatagaaaacggttactggataaactcctgtagctttaaatcccgaactgctcaaatcccatgtacacttcagcaaaaataaccacgctattgcagacaattcgagaagagataatgttttgaaatcctgaattggccataggtattcaaataaggctaaaactaaggtattaataagcagaaactctgaaatgcagaataagaatggaagtatgaaatttcttgaccatatagtgggattcaattgaagtagcaattccttcgtaaaataaatggtgaaagaagacacaaacagtgcaaatggaattctagtaaataaagcagaagttggcattctccatgttcctagtttattgcaaactattcttaatagaataagtgtaatgggtaaaacgcagagcaaaactatattccacacgtaaagctgtctagcagatacaacgaaaaaccatttgctaataatgtcaaagtagatagcaggggatgaattactttcatcatcgagaatctcctgtgaagcggtggtttgatctgctaccacatattttgacaactgccaagcaatgttaagcatatgccatagtgcagctttactagtgtgctgaactgtatccttccccgtatgatacatatctctaggcttgtagaaggcaatgtcccatcctcgtagaccgttgagttcgtaaatcttataatctgtttcgctggaaacaaacctgctataaaacccttgttgatagatggaattgccgaagggctgatcttttacggatttttcatataagagtgcggtagctgtatccgatgtcctgaacaatgcagccttggaaccggcaccagcaccttctagattaataacatatgatacaagtttgaaccactcactataagtgaatatggtggctcccaataacccaaattcttcattattgttgaagttgaaaacgatggttctttctggttggttttccgagtaatactgaagtaacgcaagaagtgataccacacctttcccatcatctgtggcaccatatccagttggcaccgagtcaaaatgggcggatagtagaaggccaggtaactgtggtgactttccttccactttaaccaaaatgttcgaggactcgtagtaaaccagcctggtttcggtagatgaatcgttgaaaacgtccaaatgttgaaagagtttagagacaccattagcagaatcatcagatacctcaataaactttgactttttcgatatctgctcgactctttgcaacaaatagtcatgtacattatcattgaaatgagaagtgtaaggatgaggtttctcggtaatgacttgtaaatcatgccaagctgcatctaacaatgaatttgatgacttatcatctggtaagtttgacttatatttattagcatcgaaccatgtcagtatactaataaccaaaacagtaagcacaaacaaggtgctaacggtggtcttcctaaacttgaaagtagaccgaaaataattggccatcattatagttggaccagggaaagaaagagcagccctgaacgatcacccgctaatttctaagaaattgtaggtgcttgtcaaacacttattaataaaacgaatggaataatacctctctttatcagttctattgatttattgtgactgaaaacccttaagtctgttttggttttaattgtacatatttcgattatactcatcttctcgaatgataactagataaagaaaacgtacatatacacagagaaaagggcattgacgaagctttgcagcctttaaaagtctccaataacagagtattcattaatcataggtatgtgcgtcttctactcttgtctatcctgtagctcatccttattccttctcgagcatgtattggcgtcttatttgaagaactcacgtgccgagaaagaaattatgttaccctgaaaatagatactggagaggaaaacatcaaacccgtgcatggtgataacagatgtgccatgcaaatttcctcgagaccttttggggacaatagttcatgcatatacgacctgcatggacgttcttaataacaacgattatctgtaccattgaaatttgctcttctacattcaggtcttagtagttttcttttcggttaagagtgcaggtttactgaaaagtgaaaccatacaaagactcgtcgtcaagatgcaagtacagaatgttgatcgctccaagttcgctccaatgaagaatgatttgatgctcagagcagctttaggtgagaaggttgaaagaccaccatgttggattatgagacaggctggacgttatttaccagaataccatgaggtgaagaatggtcgtgactttttcgagacatgtcgtgatgcagaaattgcttcagaaattactattcagcccgtgagacgttacgccggtttattggatgcagctattatcttcagtgatattcttgtgatccctcaggccatgggtatgaaagttgagatggttgaggggaaaggccctcatttcccggaaccgttgagaactgaagagcaactacaaaaggtattggattataaggtcaacgttttagacgaactagaatgggcctttaaagctatcactatgactcgtactaaattggacggccaagtgcctttgttaggtttctgtggtgctccatggacgttattggtttatatgaccgagggtggtggatcgcgtttattcagattcgctaagcaatggttaaacgaatcgccagaatcatcgcataaattattacagaagattactgacgttgcggtcgaattcttgtgccaacaggtagttgctggttgtcagatgcttcaagtgtttgaaagttggggtggcgagttaggctctcgtgatttcgacgagttctctttaccgtacctaaagcaaattgcggaaagagttccaccaaggttaaagcagctgggtatcgaagaacgtgttccaatggtagtattcgccaagggatcatggtacgcactagacaaactatgtgacagtggctataatgcagtttctttagattggtcatgggaccctgcagaggcagtaaagatcaacagtgaccgtgttaccttacagggtaatttggaccctggtgtaatttacggttcggatgagattattaccaagagagtcactgaaatggttcatggtttcggcggaggtaagcaacattacattgtaaactttggacatggtacccatccattcatggatccagagaagatcaaattctttttgcaggaatgtcacagagtcggtagtcaataaatctatcaaaaatcggaaatagactactacctttctgcatccaatttatttcatgtatataccatttcattctgtttaatacatactgatgtcagtaaatccatttttttaccctgcttagttgatcaagtctggtcatgtatggttttttacttcaatgtactttatttatagtgaaaccttgatatttcaaagtttgttacttcaataaatcttcttcattcatgaaaacttgccatcacacagtgaaacgttttaaaagaggtgttaaagagctcaaagaagtgtggattccctgaactgatgtccgacagaatacaaaagaatgacttgtacgtctatgatttgtctgatgagatcctttcttctttgcagttgatatctttcgactctgatatgaatgaggttaaagtggtccattctgatgtagaaatcgaaaacaaaaaggaaattgaggttaaaacagtaccttcatgtgcttcatgtggtattaatgcatttcctaatgataattctgatcctcgatatcattttaaaactgatttacacaaattcaacataaaaagaagagtttacggtttatctccagtcgatgagcaagagtttaggcagttgattaaaagtaaagaaacagccactgcagaagattctgacagtgattctttatctggtgaggatgatgagacagatgaaatagaagaagatgatatttctacaagaggaggagagcagttgacagcaattctcgagcatgaactccaggatttgatgatcaatgacaaccaaacgggacccgtttctcatttaaacacacaatctcctttaatattcatgcattctgctgaattatcgggaccaagaattttcggggcttataaagtactatttaatgcagaggaattgaaatgcccattgaaatcaattcatcattggaaaaatcaggataaaaccgagcatttctctgtgttgttcatgattggcggcggtcattttgcaggagcagtggtatcgcatcaaaagataccaactaatggtaataacaaaaataaatatatcctatctctacaagagcagtcagtacagtttttggaacagaaaacgttccatcgatacactaccagaagaaagcaaggtggctcccaatcagcaaatgacaatgccaagggaaaggcaaattccgctggttcaactctacgtagatataatgaagcagcgttgaaagcagacatacaagcattgttaaaggattgggaaccctacattgcaaagtgtgacaatattttcattagagccaatagtgtcacagatagaaagatcttcttagataatacttgcatctctaaaactgatgtcaaactaaagtctttcccattcactacgatgcgcccatcctcaaatgaactaaggcgtgcctgggttcaattgacgtatttatcgataacggacaaacctcaaccaaaagtcaaaaaattgcaaactgatcattcaaagaacaaacctaggaaacttacaaattctccaacaccagtgcctctgaagacagaagatgaacaacataccgaaaagctaatctcatttattcaaaagagtaaggcgccgctgttaatatcgtatatcaagaaaaacaatcttgatgtcaatattactttgcaaccctcttctgaatatcatcacacaccaacaatgctacattatgcatcatctcacggcttgaaacacatggtattggtgttgttgtccactttaaaagcagatcctacaattactaacaatgttggaaaaacagcgtgggatctggcgagtgacaccatggtcaaggaaaccttccagttggcgcgttataatttaggagaaagcttcacggattgggagcaaagtcatgttagtggagcattatcggctgaacagatagatgaaaggcacaagaagatagcactcgaagaagagaaagaaaagaaagacttgatagaaaaagaattgcaggcggcaaaggaaagaatcaaagaggaaaaagatgctaaaagaggtcccggaatgaaacttggcgccgcatcctctaacgttcaaataaatttgaactctttaactgatgatcaacggatgagattgatgagagagcagcgagctcgtgcagctgaagcgagaatgaaaagattttctggtaactagatgcaagtataaatagtaacatatataacttttacacggagtcttttaccaaagcataagtgatgtactgtcgtgcatcatcaaagacgttattcatagcttcgtcaattaagtcattagtcttttgtggatcaatatgtttgtatcccaataggcattttctcatgatttctgactttgttccatttcgaagtatctcctccttctctataattttttgggcttctagagcattgatccaaattgaagcaggaggattgtttgatggagtcgcagcagcctggtattctggctgggcgttggcttcatcagtacccgttatctcttcttcttcaagcacttctacttcaccagaacaattacaaattaagtcgtgggtattggataaagtggacaaattaatggtaaacaagtccttcaactcttcctgctgaaaaagatcatcatcattttttgattgatctgtggcactgtccaagaactttttagaaagcgctattttcattaactgtctttgaagtatcttctcatcaatacatccggttgtcacaagtctataaatgaaacatggccttctctgaccatcgcgatgaattcttgacatggcctgtaaatcaatggatgggttccaatcattatcgaataatacaagtcttgatgcaccgattaagtttagtcccacaccgcctgacttcgcacttaaaaggaaaacaaaaatagatggatcattattgaaggatgtcacaatctgatcacgggttttggttgctgtacttccatctaatcgtgcagaagtgtacccttctgaactacaatgtccctcaatgatgtctagggtttgcgtgtaatttgaaatcactactactttctcgtcagtcttggttttcaactcatgtaataatgaaagaagtattctaagtttccccgaggtgaattttccagaggtactagaagtctgaacttgactaagcctttcttcatagtatggatctgttttgatcaagcgggtggaattgcagatttttttgaatagagtaatcaaccccaatgaagagttgaatgtcatgttgctgaaatttagctgcccttcggttaaaatcttgtgaaaagcctctacttgttcagcggtaggtttgcaaaatataatgagatcagttctcggtggtaaatattgttgtaaaatttcattggttcttcttaagataaaccgtttcgttatctcaattaattgatcggatctcagaagtccttgttctaccagagtttgattttgtttagcattgacatccctggatctggcgataggtaaaatatattcccttttaaaccttccgaaagatcctaaaatcccaggattgataaaatcaattattgtatagaactcttcaagatcattttgaataggtgtcccactcaatacaattttcttctcaatatctaatgattgcaaaaccttcaagatcttagaatctttattcttcaatctatgtccttcatcacagataacaagatcaaggtttctcttctcattctgtagttcatccttgatactgaggagtttttcataaccaacaatcaaaacctgataagttcggggaacttttaggaagcttctcacttgagccttatcctctgttggagagttcctactgtgtaaggtcaacactccaattctattcataggcaaccattttttgaactccttcttccaattaccgattaaagtgacaggacatacaatgaggaccttcgatatctctccagcgagagttactcctctctggtttattatagtcggataaggtgtttgtttcaagagtgtccaaattagcgtaattgtcatcaacgtctttccgagccccatctcatctgctagtaaacatccttttatgtcatcatctctctcgagaatcatgctttcgtcaccttttgtatgtaccatgttcattacgcagtcatagagaaatttgacaccttcgcgctggtgtggtcttagtgtcttcgacaatagcgggtcaacaataacactcactttatgattctccgttttgttcatgatcaatggatctttaatggaaactggatcaaacaacggcgaataagttatctgcccaattagttcttgactcagcggtggtagagcagatttgacagttggttgatctactagttgtttctgtgctggaggcactttaggctctccgtttaggtgttttctcaggggtttgaatttggtcgttattttcggtatgaatgtctgtattggtggcttactttctatggttgctttatgcttcttggcgactggaatatccgttattccaagtgtatgactgactttgattttacatatgtcttgcacagagcttaattcttcttgatcgcttattctataatcgatttgaaactcggtagatccgattctccatatggtctcatataaatccctatccttgattggaactgatcctaaagagacaccagcttcgttgtaaaacttcaatttatcgtcgcttgtcatattggcgtatccatcaccatcccacgtcttgttcttcttatttgtaacccttctgtaatttgctgtaaataaagaaacctcctgtgatgacttagacacaccaactggtgcatttacgctggttttcaaactttttgggccggcatacgttagtttcacagtttcagagctggtattggtaattttagtatgtgaatgatgagactttggccgaaggccggtgtgtatctgctcagaaagggtatctcttccaggtctacctaccatgcgtggacgtttgaaaggtttattgacataatgattcatttatttgtactttgtcgctcttttccactgaagtaaatgctttgataccagatggggagcgtactattgcctgtgttatgcgatgtgatgtatgttgtttacgtttaagatctatattgacattatgcatattaaaacgcgaatcttgacgtgagcgctatgagggtaacagtaacaactcatatttgcgtctgctcccttggttaaagatctttgtaatagcaatgacaggagttgatacaaaaggcctcaatggtgggtaagcttctctacccgttaacatgcattacttctctttctacaaactcatccccaacatatcaccaatcaaaggaccaatacgattctgaatctcaaaacaataagaaattggttccttggcccagttggttaaggcaccgtgctaataacgcggggatcagcggttcgatcccgctaggaaccattcttttttggttttttttactccttcttgttctacggtatttcccgttagttgacaatgctttagttcaaagttcaatcattaatatctctgtccaaataacctggttgtactgccaattgaccggagacattatgttactcttacgtatcttttcctgtatctgttctatatgtgaaccccataccctggaagccaacatttcaaatttgaaaaatgcgtaatattgcaatatgtaacccagttcactaaaacattgatacatggagattgaagacaaacaattcaacaatagctaactacttataatgtctgaaagtgaggagtaccacatttctgaagccgttgataatgttgaagaaagtggctttcaattggccgaagaaaccaaaatcttgcgtgatacattggatctattgttgaacaaatcgatagaacaacgaaggatttgtgaagaattaaaacaggagaataaatatttacaggactatattgacaatatgatggaaatgggtgatgtgttgaataaatgattgctgcttttcgaatctttcccttggcattaatctcttcttcaattttcaaagctgctgtcatccgtcgacaccacagaagataaaagctaatcatcatgtatggtaatttttgtgtgcaacttccatgatgctttcttaaagtctatatggatagcgttcattcaggaccccaaacaatagatctaagtgcctattatatcgatcatgagtgttgctttaaatgaaaatgcaggaccatactcggctgcggcaacgcaattcgagaaagtcattaaagttttaaaacctccatcattgaaagagcaagcggtgaactcaaggaatgtcaagagtaagcttgatcgtgaaacgcaggggctaattgactatatcagaactccggaaccagcgcttgtgagagaaggtcatacttccaaagttcttgttaaacctcacgacctttctccattggacaaaagttcagcttccgcgcccgagattgtttcttcattcatccctccagcagaaaatattgcgaatgagagtcgattgatacatgtggacgtaccggctcgttttagtgacgtccctccattgttacctgatgacgcacctttggatttgcgatgtttggggggtagacctgcgccagggtttgacataggacccttgaaggttgactattgcgaaaatggactatatgagaatgaaactatcaggatggaatggaaaatgcagcagatactatcatgcgagtttgacgataggaaacagtttcctgcatttgcaaaggaaatggaattacgcgagaagataagtcaatctaaatggtatcactatcccttatattatgcgctaggaattgatagtactggacttttccagttgaaagatgagtttgactggtaccaaaagcatccatggtctgcttttgatcagattgagtccgactttttggatttggaattagaagaaaatgatactgcaaacacttcaaactctggttttactactgacgatggagatttgacacttccaatttcagaaacatcggaacggtcacttgaccgttatttaccctgatagatatataatttgtctaccatgtatgtagatgtatttatatgtatactctgttacatattcaattcaacgttttaaatctcaaatttgcttgagtgccaatctggaactcgaccattttgttcgtactcagatttggcaatttctaagttatcaagaagacccttcatcaagttattccaagtatagatcgacgttccgatccagggtcccattccagcaacaacgtttttttgttccacaatgcagttctccacttgactactgtcagtattgagcacaatctgctcagatatgtgtttaaagatatctatgggtagcttagataacacattgtccatcagaactgacaagggtatttcgtcatcatcattagagtccgctgaattttggtagaaaatatcaacattgtcgcttcctaatttacttgacctactatatgaatccaaaattctcccatcaaagataggaatgagctctgtattctttgagtttacctcaatataaagtccgttcctaattcctgctccaataaatgcagcaaggcaattcggcacaaaacagatagagttcaccttaagtcttccaaataaaaccttgcatagcctttgttttctgagtatcgacaaccaaagaggttcagatatcactattttaacgcctttactattatacatcaggatatcatggaaccaactcctacacatggtatgtacctgtatatcatcgtctagccaatctatggttctctgtattgtaccaacgaagttaaagtctcctgcatagccaatctctactcgggtatctcctatattaacaacaatcacgacagtcatagcattgtttttgattgaatactttttattgaatcatctaccattcaggagacaagcaatcttcgtttgttgctgatatcttttgtccatgtacggtggattaaaagatgctcttaaggaaatcaaccttaaatatagaaaaagaacttcaatattcgacatattctaaccaatgtacaagcaattaacggagcttaaaaagagaaagagaaccgtcaagaaatctccgagcatcaccactgatcactcaaaatgggacttattatatctttaccagttcagatggcagctacttgcttctcttcgatgttggggtcttgctgctcatcatctttatcctctttagggacacttacttcttcttccttaatgactcgtatcacatatgcgttatggttgctcgttaattctgttatatcatgggtatcgatgtccacgaataaatctatattatggcctgataagtcatgcacaagcacaggggagtgtgggttctttaccgttcataggttgaattttgcgttgggaatgatgcatatcattttggcatttatcatgataaatataaagtctactgcggatgcaagagcaaagttacagaacggagcatggagtttcaagttcattttttatttattactcattctatttgcttattggatcccaaatgaattctacatctggttttccaaatgggtcagtgtacccagtggattcgtgtttatcttgatcgggcttgtgctattagttgacttcgcccatgaatgggcagagacctgtatacagaatgtggaactagaagatgaaagatccagcttatggcgaaaattattgatcggtagcaccagtttaatgtacatcggaagtgctgtcatgatggttgtgatgttcactttattctgtcacgacggatgtgatatgaacagatcaagtgcaactataaacgtcgcattatctgttatcgtgtcactagcctcgatacatccaagggtacaagagttcaatccaaaatgtggacttgcgcaaagttctatggtatcagtatattgcacttacttaacaatgagtgctatggcaagtgaaccagacgataaattttgcaatccattagttcgtacaagtaacaccagaaagttcagtaccgttctaggtgcactgttcacttttatcgcaatcgcatatacgacaaccagagctgcagcaaacaacgcactaagaggtagtagcggagcgatttctttatacgatgatgatgttgaatactccgggataggagagacacgtaatcaactgaggttgcaagcgatcaaacaagcagttgaggagggtgctttgccccaatccgccttgcttgattatgaagctgagcagcaaagaatgcatgtcaatgattctggtagggaagatggtgatgatgatgaattcaatgtaacaaaatacaattactcgttgtttcatttcattttctttttagctacgcaatggattgtgatcctattgactataaatgttacacaagatgatgttggagattttattcctgttggcaggacatacttttattcatgggttaaaatcataagtgcttggatttgttatggtttatacggctggaccttattcgcacccattgtcatgccagaaagatttgaatatgactattagaaaacacctatcgaagtggtaagggaaatggatgtgtgtcacttgtttatagagttgtactattctgttcgtaaaaacgttctatcgatagaaagtatgtctttcttacgagccacccatagtggcttattcatcagaatccattattccacgctcaccaatgacataaacgcactccttttccggcatatcaggcgaatcttgtaatttcgcgaccctttcgtcacctctaccttttctcaataatattcttgtcgcacttgcatgggctaagacatgtcctccgacaggtttcctaccatcggcactagcaaacaaggcagaagcaccgggatcactttgaacttggttggtcatgaaaactgcgatattgttctcctcagcgatacgattcaatctagaaagatgttggtttagtttttgctgacgctcgttcaattccccacggcctgaataatcaactctgaaattggccataattgagtctactattaatagtctatattctcctgaagagagttcctcgccaagctgttcaagtaactccatctgatgctcactattgagtgccctggcgtacgagatattttcaaggcacacttcgggatccaaatcatacccttgtgctatctgcttgattctttctggtctgaaagtaccctctgtatcaatatatgcaaccttaccctcaggtccatttagttcttttggtaattgagctgtcacgcataacgtatgggataattgagtcttaccgcacctaaactccccaaacacctcagttatggacattgtcattattcctcctcctagtacagaatcgaattgtttcgacccggtagagatagacataactgcttgacgaatctgccattgcagagttgctggaataaagccaatggtgatgattttattggcagcttctttaatcttttctaccttcacttccgataaccctctaactttacacaaattccttctggtcgtcgacaaacaagtgttaacggtaaatataccagcagtcttcaatttagttatatcagacgcgttaattccgaagttttgtaactcatcaatattgaccacattggttttagtttctgtctctgtagacatgacagcttaaatagaaatggaatgggacgtttcaagtagaatgaaatgcaaagttattggtttttaggatcaccttctcgctcctagttatgtgcactagatatctcgctatgtcatattcattggtagttgggtttgttgatttggtttctgactccaaatcctttttatactaaaatctaattagccgccatcattttgaacgttttgataatccttccgaagcaaacacactaatagtagaagaactaatgacaaagttgagagcttgagttctattatgattttgctagtgtacagatctacaagatacttagaagttgctatttatacattgtttttgttgcaattggttggtaagaataaagactcataagaacaagactcttgggctaccgaaatcaaacgagtattgaatataatatgaactggtgtatcaatgtagagttattgtgtgcagatgcgaaaagggtgtttgtgtatgaaatagaatttgttatctgttgaagtagttctatcaaagaaggtagttaatactggtaatgaataaattagaatttcattttccatggttgagtttctctgatcttcaaaccaaatctcttatcctcggacaattgagccagtttgaatatacctgcaacgatattgcttgcagtatccatagagtaaacagaatgaacccagttagattttaggtttccgctgattcttagcaactcttcatcacagatggctacagtgacacattgacggaccacaggaactggcgtagagtgtttttttagcaaggatttcaactgtaggttggacaaacctagtttaggtagaggaagctcgaaacctgggtataaacctttattctttgccatggcgtcataacttgacacaccggatgggtttgttagatccaagatcttagcccaaggaacgtgttttacgatggtgacatctctgtcgattgttaggtagttgttagaaatttcagaaagacctaatctgaatggcttgatttcttgcttgatggtttcgaaatcaggctcctgtacgtccaatgggaaagaatcagcgatatgagctaatttggtagggtatacaccttgtttatccaatctggtcaacacttgtctagcagctcttaactttagaacatggctctttgaaaaatcacggcagatggcacctggtctagccaccacatcagaggattcagatttaccggagaattgatcgacagtgtgtaaagtgatcaaacctggctccaatccttgcaatggagccaacttcaaatcgatcatgtaaacttcacccttgacaacggtaaaatcatctgttgggaccacggtatcttcggtgataaatgggttcttacgcttgacatcaacagcagtttcattgacggttctagcaagcatagcagcttcctgatgagactcagtccaaatgacacctttgaagtctctttcgacaatgatattttcgttttgaccagaaaggaatcttttgattcttctgatacgagaaccaggcacaacgcaacaattataagattgagcaatggtgtcaactacggtcctaatcaaggaaccagtgaccttcgtagcgttgaaatcagctggaagtttggtcaaatcgtttgcagcagctaataagttagtgacggactcaacagcgatatgggtggcagctagagcatcagctttaccacctagcaaagcagcttcaggtagcaattttccagattgggcatcctgaacggttgggtaaatgaccacggtgtgggacacgttacaagtgtacccatcgatgtgacaacccaaagtgatcttagcgacatcaccaactttcaaaaacccagacaaactagaagtaacaccgttacatagctcgatcgatttggtagatctagatttttggttccaacgggacaagttttcgatgtcatccacttcaggacaccagttctcgtttatttcatcgatatcaatacaagttggcattgagattcccttctcgttaaccttattgttgaacttagtacttaaacaatcggctatgaacgaatcagtcaataaacaaagttgatgaatcggtagcggctccatagacttctcatgatacatcttattgatcaaactgatcaaaaagtttaaagcagtctgagcaatttgacctgcagttctatatttctcaattgttggttcgatcaatacattcttatctttcaataacacctgagtgtcttcctttgagatttgtaacgccatagtacggataattttatccacaaattattagtattagctgttttctgatacaaaggagggaacgatacactatgataatgatgtaagtatgtacctcgtttctctttacctcatctcatctcatcgctttaaagttttcactgatactttttttttccaaatttctttcctggatacaacctttcctgccacacagcactaagatatttcaaaaaattttccaaaatattacccggacctcgatcagaagagaatgaaaaagaaatcactttctgatcacgtgcgccaaaagtattaatattcgggtaatgtgtatcattagaactcatgacccgcatattatccgggtaatagatctgctgcccatgttccacccaaacaccgcgctgtgcacgtcacttttcccactctttctaacaacaatcccgtctgtctaattgaatcagcacaataaactctacctacaccagacgaaactgtcagatatcccataataagtagaatatcaatactctccgcatcatcagctacccaacggttcaagtttgaccccaattagagcaaaattgaccttgcttatacccacttcttgttatttcaagtcccttatctataccgactggctggctacgaaattttttgaagtttttttcccaagttcacaagtatttaaaggcggatttaattgtgaatatgatgagaaacagttgttgcgtgattaagaacctttttttggtctttcagtgatactgagccaagcaattgattaattgactgactgattgattgattgattgatttttgtcaaattttttggaacaaggaatcgttcattagttggcttttttttgttttaatatagaatcaggaactcagagcttcttcttctttatttcttctctatacaacatattttgccatcactactgctgagtgtgtatttgtgtgttctaattgttggtcgctatagtagttaataccgaaaagaacaataaattaggcaaaccatgctatctttgaaagctcaatcctctgtggttgggaagtccagctctttgagattggttagaaacttttctaaaaacgtccgtgctttgtcccaggttgctgatgaaactaagccaggtgatgatgacctagttcaaattgatttgccagaaacctcttttgaaggttatcttttggatgttcctgaattaagttatcaaaccaccaagtccaatttgctacaaatgtacaaggatatgattatcgttagaagaatggaaatggcctgtgacgctttgtacaaggctaagaaaattagaggtttctgtcactcctctgtcggtcaagaagccattgccgttggtattgaaaacgctatcactaagcgtgataccgtcatcacctcttacagatgtcatggtttcacctacatgagaggtgctgctgttcaagctgtgttggctgaattgatgggtagaagaactggtgtgtccttcggtaagggtggttccatgcacttgtacgcccctggtttctacggtggtaatggtatcgttggtgcccaagtcccattgggtgctggtttggccttcgctcatcaatacaaacacgaagatgcttgttcttttgccttgtacggtgatggtgcctctaaccaaggtcaagttttcgaatccttcaacatggccaagttatggaacttaccagccgtcttctgttgtgaaaacaacaagtacggtatgggtaccgctgccgcaagatcttcagccatgactgaatacttcaagcgtggtcaatacattcctggtttgaaggttaacggtatggatatcttggctgtttaccaagcttccaagttcgctaaggactggactgtctccggtaacggtccaatcgttcttgaatacgaaacttacagatatggtggtcactctatgtctgatccaggtactacttacagaaccagagatgaaatccaacacatgagatctaagaacgatccaattgcaggtttaaagatgcacttattggaattgggtatcgccacggaagatgaaattaaggcttacgacaaggctgctagaaagtacgtcgatgagcaagtcgaattagctgatgctgccccagctccagaagctaagatgtccatcttgttcgaggatgtctacgttccaggttctgaaactccaaccctaagaggtagattgcaagaagatacttgggattttgctaagaagagctttgctttcagagattagagcaagaacgaattaggtaattgaacgttaaagttaacttctttgcgtttatccttttttttattcccatctctctactcttcccttttcgaaagacaactatattcctataaactgccctttcacaatattatgctataaggttcacaagatgatactatttgtatagtgcatctgctattttccaccaatcaatattaaagtaccaaaatcataaaaaaacaccttttagatacaagtgttttttattcatttcattcacggtatggtttctattcagataactgtttttttcggttttaaaacatgaatgttcatctgtgacttctcattctctctctctccatgagacttcgttgatgcttattctcaatgccgagaacattatctggttactgatgcctgccattacggattacctgcgttttaatttcttcccaaacaaaacaacgatacagaattttctcattactcccaaaaactacctcaataattcgtgctacaatcttcttttcttacgttgatcttgcgcctgttataaacatgatttattgtgaactaggttttgtaaactaatctgacattgttcttcaccataaattgtctctcccctttttggttgctacgatacaatgtcgtcaaatgcgaagccgcatattagacagatgaaaagttacaataccttgtccatcattgaatcatctactcacctttctaatgactgatctcacgacgacttaccccaataatcatctcatctctatttactagacttacatctagtctatatataaattgtatttactgaattaaagtatcatagatatactagagacagttttgtcaccctggttccagagtcactgcaggaccctactcatcgacttcctaaaatgtacactttgtcctgatttcatcactatctctgttttcatttaagggaagaaaattattcattacttaagaccgttgatgtttaaatctgaaacaacctcaaaatggcatcatgatgaaaggggaaaatatagtgattgcagattccgggagatttgagattcttttagtgaattctccaaagtagctaccatgatatcgttacttatgtgctaatctatcaattgaataactgaacaattattgttcaaagtattaagaatacatccaaaagtcttcaaactttaaggaatttaagagtaacactacggctgactagagcatattaactattactttgctagaaatgtctagaggtaatacatcatcaatgaattctcaggatatcttatttcaattgactaatgtgggatcctccccggtgcctaaactggatacaggatccacttcagggtccaatacctcatcgccaagaagatggacagagcttttttctaagaagagagtgaagacgccttcagttggtactccatcgactgcatcatccatgatatcttccttctatgatagttctcccataagaccagtgtcaaaacagcatcctaagcacctcctggtagatccgatcatgccgcctccacccataatgctctctcccattggacatgagaccttaggaaagaagcccactcgaaaaaatggtaataagtcttggaaaaatgagagatgttgcatatgcggagatctttgttcgttcaagggttctaatgagaaggtaatccctttggagtgtaaccatatgtgtcatgaagattgtttaatggtgagtttacgacctcttcctcataaatcaaacctgtatgatgccttgccgaaatgcgacatctgtagtatgtcatgcataccgggacaggaagatatgcgacagaaggtaaggtcacacttgttaaccttacctgatgacggtgaaagtgttggactcgaaccgtataatcctcaagaaaactacgagcggataaaattgtgcgatgcagacctcttacccaagcactcaggtaatgatgaaacgtttccacatttgcagactactagaacaactgcaagaaataacgatatcaggttatcttttgcattttctttgaaaccagggaaaacggttactccatctcttcgagattccatccgtttgcataggagtcgcagtataaaaagaagatccaacttcagaggaagtacggtttctggcttgtcgtccatcgtatcatcttcctcgaaagatgactgtcaactgccttctttgcacgttcaaaggcagtatttcattcaagcgtttttgaatagttttagcgaagtcaagccttgggaaattgatgctaaatatggactcttacgattgatagataattttttgatatcattagatggcataaatttccaacaccaggtttgctacctattttcggaatatttactagtatgtcgaccatctcctgctacttcggcaaatgttcttcaattctcgagctaccgttgtttccaattgaataatcctcctgaactagatttattagatgcaactactcttgaatcaaaatctcgttctggggaaagaattcttattaaaccttatgggttggatacaaaagctttagaaaaatggataacagctctatttgatcttactttgccgttcggaaattatgatttcacttcgatcaaggttcccgaatttgtggcttgcattcctagcaccaatgatacaggtacaatcattgtcagacgacagagtaccttaaatgaaacccttatccctaaaacaattcgagattcatccgtgttaacctcaatatcatccattttgtccatcaaaagagcaacaccaaatgaattaaatttggtgttgcaattagataaaagaaagactaatgaagataatatcgtctcgatcaagaacgtcattttagctttgacttggaagttttctacttttaactgctgtattgttgatgttgaaggaatggtcatcaattgcggaactgctaacgatgttctcaattcgttggctggtccgataaaaagtaatggtaatcaaccattctctccagatcttttacaccaattatggtatcggcaaaaacagaaaatatgcaaaaatgttggggttgttgttttatcaaactcatccatggagaatggtaaatcatgtctttttagcgattatcgaatattcgctgatgcaggcaaacggcatccaaatgaattaaaaataaaagtaggctttctgaatgtagattatagtgataatatcaaagaactcgttgaaattcaggactggaacgaattgcttgaagctgttgcctatagttttaatttgagctttgatgatgatttagatagtagtgactgtgtcagtacctcctctagtgattttgaagtggattcagttccagataagaatagaacattccggctttcatcacctatatcctgggaaaatcacgtacaggctgacttgacaggatctatgaatggtattagtgaatctattgaagaccggcaatcaaatcatatgtacgactatttataacattttcactctctctaattcatcatatatttttaccatccacaaatctctctcttgcctggatcgacacataaaaatcatcgattttcccgagactccaagtttatcaacaacgtgaaattttgaagagtccggagtttctggtgttattactgaacttaacattatccttttgtttggaaaccacataacaaaagtcctactactctcttcatccatgcttttccatccgtcagcatacactcttgagagactatgagaacctggattaatagagttaaagtctttgtctcggtccaagagttcctgttcactgagggcacctgaatatagatagcatttctctatcggaatcgttaaaaaatgtctatactttgtcgaatctttcgcgtagccccttatggatctatcgaaacagtggtacaacattataaacccaggaatcaacaccatgaaatgcttgttgaatactgaatgttttctggatttatgataaattaatccttggtgtattataggacgcgacaaagcatgagcgctgacgttgtaaatatgatcgtttgttgttgataattctgtcatccatttcggaacaaatgcagatatgtgcttttcctgaagttcagttatattgaaggtgttgagattctttattttcaaatcccagagaagctgtcgatcagcagctagtcttcgcttccagtagaaggctatttcacgtagtcgtgataaccactcttgacatgtctccggatcaggcgccatgagtagtttactgacatttttaccaattactaactctataatagaagacttcgttgcttcaagtgtttgactattcttccataccatattatttgcttcattccatattttcatggtcttaatattgaagcccgatgcatctaaaagcttgatatctgtacaacgagtcaagtcaatgcaattatccgctttgagtattagtgatatttttctcaggaatgatctactagctcttgcgtcgtgactttcaaattccgcagttgttatattctcgtttaaccaagcgaaatgaccattctcatctaatggatatggattatcttcgtacactctaggcatggtttcaattaagtcatctagcctggctttatctaatactactccgaatggatcgattacgtcatcttccggtagtggtggtgtagccttaacggatctagtcctaaaaaagagcccgtttgaagtgaaccagtaggaaagcttaaaatagggatgtgagagtttatattcatttttatcgctgaaaacaatattgttttcagataaaaaaccctcaattggcgagggctcattaatgaccttaacggtatcagtgtgattatcgatgggtttctgtatggatctggggtaagttttaagcctacgatattcaaatatgtgagattttctcaaaacaaatgttccgtacaacaaatcagtttgattgccgtaagaccattcaatcctatcgtaatgtttccaacatagtcccattagtatattggaagcatcccattttttaacctcatgtaaatatccaagttgtataagcgtctcacgtataactagcttcaaatatcttaatattggaagttgtgctacacggtatccattttctagttggaatattttcatcacttcctcctcttctgccgccttctttgctaatttccttcttattatttctgggagatctacatttagtgataaatttactattggaatatggatgtcaatgtcacaaggttgtgctgcaggaccaatgctggatctcaaaaataccaaccacctactagatgataatagattatcacatcggaatatgaaaattttcaaaggggaaaattgtttcttcgatgttgctgttttcgtttttgcattatccgcaaacctcatttcttgtgttaataggtcatcttgtttgacaatgcaaatacttttgtccaaagaattataaaattcaacaaggcatttcttatctaaatcaaactgaatcttgcaatgccatggttttctatcctttgttactattggtttaatttttcttgaagtgtaaagttgtagccttactggagcatccgggtttcccgtccctctagctacaacgaaatactctttccatcgttcataaattctagtatctactggttcatcttcggagaaatgagggggaattactctggcagttaaagcttgcttaaccataacaatcatcttttccatcttgatgattttcccaattttagtactatctaaagtgattctattatgttctggggagggtttttcccaaaaactcccgaaatgagcgtctggtaccacggcactaatctttttgccaatagctttgaaaggggtataatgtgcatgcgaattattgattcttgtctgctcctctcgagtaatcggttgaggaatcggctttagtattttaagtggatctttactgttgagtgaacttcttctcgacgtaaaagatcggaatgtctgtctcgttggatgtctgaaaataagacgttggttagcattttctttgtttagtgtgtaggtccttacatctaaagatcttgtttcattgtcgtctagtacagaaaaatcggtaggtgcttcattgtactcgagagattgttcttcaagatccgaatttactgtgctttctccatcatggccaattaacggatcctcaaaatgcattacatcagcatcatttccacgatgcgcatcactggttagccctgatggactttgctgcactacactaggtgaattcaagcttccattctgtaatgacgcttcgccgtcgtcttcgtcattatcatcatcatcataaacagtgacaagtttagagggtttaacgttttcatcgaaagctttgttcttatctgcggaatgatactgcctccaatgtatgaatcttgtctccttacctctacctttctcgtaaacgtattttattctgtttcgcaatcgtacatcagtcagcctctcaaagatcgtgaagatgttatatgaatgctgaagattccatatttgtggaattccacctattaggacggatcgatgactttgtgaaatctccacagcagagcaataagttagctggtgggaggtgaatgagtgcttggggatctcgatctttttcatcgcagattccccgagacctgcattttccctgatgtattgtaagaatctatcatcatccaatacaatatctattagaaccttaattctttcgtccatatgaatgtaaaccactcttctctagtgatatttctcaagatattcagtaattcatgccctgctcaatagtagtaaccatcaagtatcgtaatgaagaattctctgtttaagtttttataagttgtgtttgtgtacccttgaaatgaaattattccaaagatttaagcaaaggttttcttgggatttatctctgtcagatgaaagcgacaaatacaacaactatttgagatttatccacataatcttggttgcatgtcataaagagttgaatttcattatgtgtatttactaacagtatgtaggtgatgtgaagtggcacatatatgccgcttcaggcagaccagaactaattttaaaatatcaaggtaagaaaccattttgtcatcagttataatggcaagatgtttggagagggacctaatggggtaattgataatgggttgattttagtatgggatctagtgtaatgccatttgatgtggttgaaattggtagtttcttggaaagcttcgtagttccaatataagtttctgagccacaaatggatgtaagggtaccccgagcgaatagtgttcaaattggttttgaaatgctgaacgtatacagggtcaaatcttacaatggtaggatataatctcaagtcagcctcagttaattgatctcctaataggtatagtttctttacaatttcctcctcagaagaatgagtagatttcaaagtttcgtaccttttctttagtatgccttccaccttatccaaatgtttgaacacattcaatacttccttctcgtagatgtcctgtttctcagcaaacccggtcttgtaaacaccattattgatggagtcgtagacccaggagttgatctcatcgatttgagattctaattcttttggaaccaaatcgatgtctggatgagaatctgccacttcattgaaaacaccactgttgaaaattctaataatctcagaactttcattgttaactatggtttgggtcttcaagtcccatagaacgggcacagtgaatctggctgcatattccggttcactcttgaagtacaattcgctaattctttggaaatggtaattgtgatcgatggtaccgtcaatgccgtatttgatagagtgattatctacatcagcgctgacacagagatccttttcacatttgagacctgcggatggtttgtacgattcctttccatcggttttattcgattcattatatggtaaaaacctccatcctttctcatccatgtgccaatgcacaacactgataccaataacggacgttaatcccttcaagaccctggtaatcaaggtgcggtgagcccaaggacacgctaaagagacatatagccaatatcttcccttttcaggcttgtagatgggatgggtggaagaaatggtttctctgaaggaggagacttgtctcttaaatgaaccgtcttcactggcaaacttcttcgacatgatttatggctatttgtatattgcagggcaattgtatatcaatgtttataacgaggtgtatttgcccccaccgtctggtggtaagggaagcgtaacttattctggagaagcattccctttttatatctaaattaagggaattctccgttacaaataatgacagcaatttgtcattatcatgtcaaaagacaaggaattacataaggaaaagtaaggtttgggaggtaattttactaatgcatttagtcaagagctcactgtggttgaattgaaatggcttgtacatgcttaatatttgatttggcattgtagaacgtagtttagtctttagtttataaatgttgatctggattgtgtctttcgatttgcgaattgcaaattattagtgacctaaaatcacattggccctatgaatgattgaatataaagtaataatattgtttatgctagcatttacgtatgacaccccgctcttgtgtaagaagtcaagaagggcgcgcgcttctacctttctctagaaaagatttatgtaaagtagtcagaagtcattccacagccttagacgatatcttgttcatcgtcattagcagacaatgcaatgttagttgtcttgaagtaagtaggctcgccaacatctggatttagatgcaaaaacagatgcaccaatgccattggccacaaaaggacacccacaatgatactgaagacaccatcatatttcaaaagtgcgtataataaagtgaataaggctcccctgcctgcataagtgtagtagaaagaggcatacttatcgagtaacggcaattccctgaattcaagcacaccgagtaagatagataaccctaatccaatcaaacttccaacaaaaatgtccaaaggtaggatattaaagatcgcttgggtcaaaaacaataaggtcaatacagcagagaatccgatacatgcgaatctgtaaaggttcaaaatttgtgagtctgacatggttttaaaaagtaaatcaatcaaatctgctaactgctctagtcaccgcgtcaattggttactatttcccgttgtatcagctcaatcagattacggtatggctgtttcgaagttaagtgttggtaataatgaaagaaaatcccttttgtaactaatttgacatattagttttgtccaaacaaacatattttacctggggttgcattctgacagaatgtgtgttcaaacggtcacgatatcaggcttgaagtaacgttacgtactgcaaagtgtagaatggttcactttatgtatggagctatatataccgatctatacttgtagttagaacgtttattgtattccgtggttctgccagatgaagcagacctacagcatcaactaaaacacaatgcaactgagaaaaatcaggtcaccaaataagtgggatgtgaagtacagcgtactagcagtttagccctgtttgtgcaacaacatcctataaatagagcgatgaagtattttatttcattgctattactgtgctttgagtgaataagaaatacctggggaagcaacaaaataagaaaaaagagacattgatacgagaggactgattgaagtcaacgaacaatcaatcaactgtttggatgatgtttaagtttcctttatgaaggataaaagagagaatatatatagacataaattaatgtaatgacggtgaaggaggggaataaaactagaacattaatcaattagacaagccaggtgaaagtgtagtagttaattagtatagttaaacatttattggttactgtttatttttatgggcagattggatacaaatagaacaaaatggtagcaacagcactaataatatcgaagagtagtctggtgaacaataattaaactgaatttctctcctactatccgcttccaagttatttataaacgagatagtgtagacataaaaaaaaaaagacgatgaggaagtgaattatcttgaacaaaaaggaagaagaagtttcgggcagagttcttcacataccgatgtgctatgacagggtgttaaaactgattagaaaaaccgaccttgaatacaattccagttgtatttttttgtttgcatgtgttcagttcttcggagggcctttgttgcaaaactacaattggaaaaccctgaaaaaactcttcactattgttcaatgtagttacaaaaaaaacaaagaataaaatccactcccaatgaaatatattttatcatttcacatataacatacatatccctatgaggacgttacatgtaattgttaaagttttgtatcgtttcatgtattttcgtaagttgctcgagttgagttaaagttggtcaagttcgatcgctgactatggactcaaatatttttatagttgataattaacataaaatcaaaaaacctaacctcacccaccagaagaaagaccagaaaaagataaagagtaatagtaagagtaatagtaaaagtaatagtaatagtaaaagtaatagtaatagaataataaaaggtataatattattgcatttccactttacaaaagtgcgagtattttaataatatcttataaaaaaaaagagaagaaagattatccaatagcgtttacaattcaaatttcttgatattccagttactttgcttggcttagtttttattcgaagtttatgagtatgagctaatgagcgctgagtgtgtgtgtgtttgcgtgtgtgtgtgtgtgtgtgggtgtatgaatacgtgaaggttggagaaaagaaaaaaaaatgtaaatttggtttcaaattagtttaatatagtagtaattctagctgttcgagttgctgttgaaacttagttctcaattttttttgtaagtttgtagttatttttttttctttgatggcggggcgtagtgaaggggtaataccggacgttagagcatttaagcaccttcagcaggttggtcttcttgaccagtctcagacatatcagaagtccacaaggtcaagttatctctcaacaattgcatgatcaaagtactgtccttgtatgattcttcggataaggtatctagttcagcaatagcgtcatcgaaggcttgcttagccaaatgacaagccttgtctggggaattttgaatttcgtaatagaacacggagaagtttaaggccaaacccaatctgataggatgagttggtggcaattctgtggtggcgatatcggatgcttccttgtaggcttccaaagaggcttgagtagcactttctctaacgtcaccggaagagaattcggccagataacggtggtagtcacccttcatcttatagtagaataccttggattcaccggttgtagcacttggaatcaaatgagtatctaacactgacaagatatcatcacagatcttagtcaattcggattcgatcttcgaacggtaagttctgatcaattgaacttgatgttcagatttttccttagcttcctctttttgttcaatggaggaaacgattctccaggatgcacgacgagcaccaataacgttcttgtaagcaacagataacaagtttctttcttcaacggacaattcttgaccagaagatgcaacattcttcatgttttccaccatttcttcataacgttctgcttgttcagccaatttggctaaatacactgaatcttcacgacttaaagacattttttcttcgtttcttgataataatattctgttgcggtaagcttctagtttaaaaatcggttatcctttaaaagtatatcacgagtctttcagatttaaattcaaatttaatcaaagacacttcaaacagtagaaataattgaaactctcttttgtatttctttctttaaaaagctgtattaaatttgaattcaccaaaagttcagtaaccaggtaaatgaattgttagtaatgtattcgtaaaattaatagaacgaaggaggcaaatgggggaaaaaacaccaccaatctgatttgtgagatgcgtttgatctttttcttgtctagtctatcaattgttatcaattattctccttcttcaattccttttttttttttcaaaacatgccacgtaccttaattggaagaaaaaaatattattctttcgagacgagtgaaactggtatagggaaatatacttgtcgttcgttccttgtctctctcttcttcttctaatctaatcaatctcttttcctgtgttgttattccacttgtttcaaccaaaacttcaggggctttttatttatttattcaattttcaattttcaattttttcaaatcaattttccaaactttttttttttaaaatttcttgtctcctgtacagcattataggaaaacgaaacaggaaccaaaaacaacacgatatcaaaatagaagggaaagggagaagaaatactgtacatacacagatcgatagaaggaaataacagtatcaatgataaaaggtaattgaaggcacaaaatcacacaaacccacaaatatgtttcaattaaagaagaaaaaaatgaccgcaaaaaacatcaaagtaagtagagatataagtgatatcgaaattttccccgaaatataggaccgatcgattgaattattttatttgtaccattcagtaacgtactctaatagctataaatcatagatccatagctttagtgtatagtcactcgaacggctgtcgttaaaaaaacgacgtaaggcaggaagacaggtcaaacacatggatcaaaacacaaatcgcaaaccactagatatgacaccaattaagatggacatagataacaaaaatcacacatacaattctattgtagttttcagctagagttctaattgaattcttctagaacaaaataaagatatttagtctttacagcgtgacaagagaggttcagtttccaaataatattattctaatcaaaaatagaataatataaagtgtatatgctaaatatcgttctattttatatatatatatataattattatatcatgggaacaagagagtcaagaaaaacaaaaaaaaaaggacaagactgaaaaagcatcatcaagatatgatcaaaaccgaaaggacttaaaacctaaaagctgctaaaaggtgactctaaaagaaaagagggaaaaacgaggaaaagaaggaaaagagggaaaagaaagcaatcgattgaaaacgtaaagcatatgtaattggtttagttcaagaaaatcggtttgttattattattcttgctctcttgtttctttgtttcttgctttacaattcgagtggcaaaaaaatcgagctttcttctgaattcctgtttttgattgtttttctcgtcttttcgctcagcggaattgcttagataggggtgtagctcagcgggcaacggtacgaggaggcttgtttcctactggtgatttctggctcgcccctgttttatttttgtgggaaagaagcaggggagggtaataccataatcagggtaacatttatgttaccctgatatactgtatatatatatatgtatgtatgtctcatctcacatgccgtttgtaatctgctgattttccacaccctgtgacttcgctgtgatcatcggtagtcattggagaatccaattcacatcaatatatggttgtgtggccgagcggtctaaggcgcctgattcaagataccaatcttaaccaatcttacagttgggaacactcaggtatcgtaagatgcaagagttcgaatctcttcgcaaccattatcttttttgaaaggttccagaaaaaattttttttttgaacggttctcactgtcagaatctttattatgattgtactttctttacattccaatatgtcttatatcgtgttatatacaattttcgaataaacaatgccagagatgagtctttccttcagaatcgtcttcagttatattatccattgagaagttcctctctatttcctgttctgcttcttctacagatatcttggatcccgatgcgcgtaactcttccgtctttttcttcttcttcccctcaagtacggctttgtacttcattatactctcttcgacagtatttcttaccatgaaattccatacgtaagtaacgtctttttgaccaatacgatggatacgggaaatagcttgagcttctgtcgatgaatccattattggttccaaaagaatcaaatgtcttgcattcaccaacgttaatcctgtggactgactgtgtacattcaatagcaaacatgtgcagttggggtcttttctgaaggtatcaacagctttagcaaatttggtgtttctcagtggccttgcgtgagtcacgttatgagcggtcaatagtgtggagagaatactcaaaaatgcagagtgcgaggaaaaaatcacgatttgagggttcttcttatgcggttctttctccaaatgttgctgttttatatacaatatcaatttcatcacttggtctaccttggcaccccatgtgttatccaacattaccttatcaacttctgttaaacgtgggaatttagtatatttcctagtaattacagcctcggtatcctcctcatgtgtggtgtcgttcccatcactgctggaattagtttgatcgtcgtccttcgtcacttgctctgggttatcagtatcatcttcttccttcaattcttcttcacggaacttgaagtgatacacttcggaacttgacattctgtttttgcacattggacatgaagtgttctttttaaaccagtgagtaacacagtccttacagaagaaatgtccacatttcaagatagaaccagtgtaaatgtcggaataacaaactgcacaagagatattttcaccgttggcgatagcagtcttcaactgacctaaagtgtccaaatatcttaccctggattctaaattgtttattactttgcaattgtcgtcataatcgtggcccctagtcactttcttgatgatattatttctcgtagtagcatttagttccgatagaggcaccaaggagtcagaaattctttgcaaataactgtaataattggtcttggcattatagatatcattaaactttttcaaaatgttccgtaattcttggttttctctcatcactctggtgatctccatttcataacaattgatgaactcttgtatgttgtgatgagcaagcttactcgaagatagataatttttcataggcttgtcgttttctgcttcatttaataacatttttaacgacgagccatcgcaaaatactatgctcttcaataactcttcatgaaacttggaatcaacttctgcaatcgcaacttctggcttaaagggttctagtgaagtttcactggcaactgcatcgtcacgattcttcaagagtctctctaatacatctagcagagaaaacaccttatcttgttcgtcgacggatttctcatactccttcgacttttcagcatcttcaacattttcgtaatcctttacgatagtgttatatgacatcacttctaaatcctttatcagtctgttaaactgtttgctttgctgattcaagatgtggaaaagtgttgatatttttcggaatcctaaggtttcaccaagaacattaccaaaattgcttttgtttgatacaatagaatcaagaagcattttgcggaccacctttttgttcattaaccaatcacggaccttgttaatctcagcgtcaacatcaaagattcgttcgtgcaacatttcccttcttagtttttcagcaatttcatagttctctttttccagctcttggaacttgttaattgtagccagctggtccactgtgaatatatcactatactgttttgggtcattttctttggctggatttttcttgttcttgttcttgttgttatttgtattattgttctttttgggcgagctcaccttgttaacttcagcttcattttcagcatctatgtcttccaacttcttagagccaagttgataatatgacgttgccaaaaagaaatatgcttggtgtaaggattgtaacaatagacgaatattattcgcgtcctttacagagctcatggaagagttttcattattaagtttcaagaaatcatgtatgccataaacattctttaaatcatcagttatatccttgatgttcttctggaaaatattggcagcatcttcaaaatcctcatcaatttccatcttcacctggccggattcaagttgcaaagagtagttttccctttgtaaggtgtggattctatccagtacttcatccttcatcgtagctaagattgcatccatgtccttgagctcatcattttctctccatggatgataattaaaatcagaaatgtcatcctttagtagtgatgcgtgacagcaaatcatcctaagcctattgagccatctagaaagttccatccgatcaatatttactgctccgtttcctctaggatcgtatcctgaatctgccaaaaatgaattccacatatgtgcataattgtcttgttcaatagggttgaattcaacgggaaccatgtaattaatttgcggaggaatcttgatttgatcttggacatctttctttcgatgtcttatagctaggttgaacttaggaaagatatccataatctcttcaggttcaaacttacatcctcggacaccattccaattttcatcaggaattacatggccgaggtgagtgtagttttcaggattttctgcatagttggcacgatgaaaggcattggaagtgcagacagcgttaaccacattctggtctaaaacctggaatggatggatctgtaggtaaacaaaaatatcacgaatatggaaataccactccacaggggtacctgacaccccccaagtatgaaccctgtggattagacttgtacagcgtgaggcattggtcataccgcctccaagtagctgtgcctcatccaaaatgaccctatggaattccataatagataatggagaagtgtaatcgtatcgtctagtagagtctctactaggtctttgtattttgctaaactcagcatagtgaacttctgcagacatcgtatagtatgaacatatcacaacatcgtattgagacatcaattctactatttctgccggtgaatcagtgttgaatttatttcttgtcttttcgaagccctcataatgaaacactttgaagtccgacacttttttgttgatatgcagatcaatttcgtcaatccattgttgcaagatactttctggacagacaattaggttcgttttaactcttctaacctctttttcatttattggagaaacgaaactgcttgactcatttgatagattccgtacattagtagagatcaaagtcagaatttcgatagttttccctagacccatctcatcagcaagtacacctctagcctttttcccactggaagggtcagagaaccattcctcatatattttccatgcctcctccattggcagaatgtaaccagtaagcttattccaaaaactatcattaatgggcatatattcatagccatacgagatatgctcatttaagaaaaacatgagttgttctcttgttgtgattctttctaagggttcatcgtaaaacccctctttccttagcatccaatctatcgattccatttgaaatggcatcaatgtcacgtcaagagcttttggcaccgcaataacaacatctttccgcaacgccttctttgagtaactaaccactaaggaatcaaaaggttccttagctcggcctggtgcaaactctccaccattgcaaatgtactgcggatctttctcaagaaagagatcacccaataacttattcgtttccatgccaaaagaattagcatcgttgatagtgcagaatagagaaaattgaattttaaccatccagttaccagatgaatcaattaacattactagcggatgtaatttgagatctttgtaacggtaggaggttggatcacgaggggtcacttttcttctcttcttcctacttttcttcgcaagtgattcctgtttctcttgttcttcagcagcccgaacaagctcatgccatgtctctacttccttcgctttcacttcacaacattctatcacttgcttgaactgggggctccattcagtacaattccatttccctaaaaaccaagaatcgtgataaaaatggatccatgtcttatcgtcttcctcattacgctcaaatttcaacgaaacggaaacttgtttgaacccttttgaagaactaaaatcaccaaaccttaactcccaatccaaaatggggacagtttgaagtttactggtagctttcttctctaacgattcgcacggctgtaacgactcgttaaaagcaaatccagacacgccaccttctataaactcaacatccttctccaggagtttccattcaacagcagaacctgtaggaaacttagcctcgtcagttgtcatccgtaccgtgtcaaatatcctggctgtcctgaactgtagattgtctctaactgtaagtagttcgatcgaattcccaatatactttttaaagaaaaatacgtatatataatgggaaaatgctacagccctacacgaaacaggttttatgttttatcttccccgtaaatggtctctaaatggtaaaataggaacgccctttaacctgcttatggcttatcaaggttgcaaaatctgatgagaggcttgcaaaccttaatatatatgttactaatggaaagaaaaaaaaagtcaataatcatggttagaagaataaacaaacaacacgacgtcacagcacacagtgctagtacgaccttaactcacaaaacatctgaatcatgcgtgcgcgcgtgaaatcaccgatttctgacttggagttaacaacaccaagcattcaatgatcttgctcatactttactgtatctaactaggtgtttactttttttttcagcgtgaaaggaaagtatatacagagaccgcagaaagtcggaatttttcacatatagaacattctccatactacaaatcatgaatagaaggagacaagtatatttccgctgctcgacgtacacggcggaagccacctgatttaatcctattctaatttgggggtgtcttcatccgccaatacctagttcgattgctttaaaaggggtcacgttaaacagataattagtatgctcgagatcggatcgtagccacatatgtagttgggaaaaccgagaaagctaaccgaggtcacgtgaatggttttaattgttacccggaacagtcagtggtatatagaccagtggtgccatatccattcaggctcgagagagacattactcaatcgcaatgtcaatacttatagcgttctccatgattttttttctacaaggacgcgggtaacaagagcgtaacctaaatatcccccagtaggaatcttaacaattgccccaataattactgtagcaatctagtgcactttctgccttgtagcaatgcaacgagttacacataactgcaatgcatgtgtaatacatataaatatatatatgtatatatgtatataaagtgtttacgtatttttgctagtcgtagtgacatattttgctaccagtggttctcaacacagactgtactcagtatgtacggtatatacaccacatacaatatcaatatcttcacgtattgagttggaatcttacaaagtgcgaagagactccaagaaaaatattagaaacaaaaaattaaagatcgataatttagaaaaacaacggtttttctttatatgcctttggaattgaagtaaagagttttccattaatcttctgggtaggatagcagtggattgcaccagcagcagccgttgaaacgctagcgaggtgtgctgtagatatctgggaagttaatacaaaaaaaatgttcaagctgaagaatatgttcaaaaggaagactcctccgcctcctgtagcaccagagaaacccggacatcgaagttccagtggtgattctactactttggagatctctttccagaaacaattgaacgtctctgaaaggggtgctaatggcgatggttctgtcagagtgattgatcgtgaggctggatccactagcagtaattcggaggagccaagttcgcatcatgtacaaatagtacaggggaaagatggcaccagtcaagaagagaatacatatgatgagagttcggatgcgacgacaacgccgcaagaggagccagaagatgtgtttccagagcaaacagagttgaaggattacacgttgattcaaaagatcggtgagggagcgttctccaaggtataccgtggtattccctcgacttccaattgttcgaacggagcgtctagcgtgattgctcagcagtacaaggaggttgccatcaaagtaattatcaaacagcagttacctaataccaataagaagggcgatgaaaagaatggtaagacttcgactgcggagcaagtgttgaaggaaattgctattcataagatagtttcgtctggcgagaacatagtttcctttatcgattttcaggaatcggaaaaatattactacatcattcaagagttattagccggtggtgagatctttggggagattgtgaaatatacttatttcagcgaggatctctcacgtcacgttatcagacagctggctaatgctgtgaaatatatgcatcagttagggattgtacatcgtgatatcaaaccagagaatctattatttgaaccaatcgatttcattccaaacccaaagccaaaactaaggagttctgatgatccgtccaccaagctagatgaaggtgtctttagacctggaatcggtggtggtggtatcggagtggtaaaacttgccgactttgggttgtccaaacaaatctatcaaactaatacaaagaccccttgcgggactgtaggatacactgcaccggaggtggtaaaagatgaacgttactcgatgcaagtagacatgtggggcgtgggatgtgtgctatacacggtgctttgtggattccctccattctttgatgaaaaaattgatgttttaacggaaaaaatatctagaggtgaatacactttcctaagaccatggtgggaccaaatcagtgacggagccaagaactgcgtaaggaaattgctagaagtcgacccggctaaacgttacacatcagaacaattattacaagatccgtggttgaattcgtacgattgtcttccatcggctgaccattccaatgcaccatcgactggtgaaaagaggagacattcgcacaagcattcaagaaaggcatacaagaaaaacgcatcattattatactcacctgctgccgttgcaatgcgtgacgcatttgacgtttcaaatgctgttcaacgtatagaagatgataaaagaatgacgcctgggcctaagaataactacaacaacaacaatttgggcgtactagcggaagatgcagaggcagaaatccaatatagagaaccgtttactttgaaattggacagcagttcaatcataaaacgtcgtcgtaacaacgtgtagattaacttcgttttcctctcgattcttatacagattattatacgtcacaatttccgatgccggtactgtgtaccgccatctctctttctcttcatatgattcatattcagtttctgtactgccaacgccattatatatatgtatactcatattatcattatacagaatctaaccttcaagcgttatgaaagggaaaagactttcaagagagagatccagaaacacttacccggacacaagccgattaacagttttatcatacatccgggtaacaaaacctcccaacgaaattcaaactacaatccgttgtgaaacgagaaacaatagataacctgattaccctgcacacaattctacacatcttcatgaaaccttcgaattcagcaaaaagaaacatcgcctgtgttcatctctaccaaccactctttgagagcatcaaatcacatctcacatcacctggcacgaaccaccgttgcatttctcttttcttttgactcttttttccctcgtttcagacagcacaaaagagctcatcgcatggtccgctgtgatgcagcatggactggttcctttttgttccttctgcgtgctaaattactactaagagaacatttttcttgccagcctggcgatgaaaggaaaccagcctagtatctctgcctagataaaaacttgttaaatccggtaaaggattattatatctgatatgccatgatgatctgtagtgtaaatatgtcactctacctcttgggctaattaaatataaacctttaattctatcatacacgataccaatagcagcactgacgtgctgctagtactgctggcgtcgccagcaccatgtcgtttcttgttttctctttcactactttaatcactgcaggtgtctaatccatccatctcatccaattaagctcgaaaaagaaaaaatgaaatttttttttttttttcttttcactatgtgaaaaagaagaaaaaacagaaaagttttcaacagggtatatattaggacttgagaagaggtaaatttttattagttataatcaacttagcaactatttaacaggttgtgtgattcagagtttgaactgatatcaagttagtataatttaaagaactttttttaaatccttcttcttttcttgttgttgtttaattcactttagttttaagtattctttattacttctttttaagctcatcacatcaagtactattactcccagatccgaggatagagaaccatgtctgactctgcacaatccgtcaaggttctaaacgaactattcgagaagttgacagttgccactgctgacaacagatctgctattgccaatgaagttgcatcattcttgaacggtaacatcatcgaacatgatgttccagaagaattctttgctaacttgagcaaggccatcaaggacaagaagactgctgctaacgttttggaagctgttgctcacattgcctctgaatctggtttgtctccatctgttgaaccattcattgttaacttggtcccaagcatctgtgacaaggctggtgacaaggacaaggaaatccaagttttggcttccgatgctttgttggctattgctaaggccatcaacccagctgccatcaaggctttcttgccattgttgacttctgctttggattctacttccaaatggcaagaaaaggtttctatcttggctgttatctccgttttggttgacactgctaaggagcaacttggtttgagaatgcctgaattgatcccagctttgtctgaagctatgtgggatactaagaaggaagtcaagcaagctgctaccgctactatcaccaaggctactgaaaccgtcgaaaacaaggatattgaacgtttcattccaaagttgatcgaatgtatcgctgatccaagtgaagttccagaaaccgtccacttgttgggtgccaccactttcgttgctgaagttaccccagctactttgtccatcatggttccattgttgaacagaggtttggctgaaagagaaacttccatcaagcgtaaggctgctgttatcattgataacatgtgtaagttggtcgaagacccacaagtcgttgctccattcttggaaaaattgttgccaggtttgaagaacaacttcgccaccattgctgacccagaagctcgtgaagttactttgagaggtttgaagaccttgagaagagtcggtaacgtcggtgccgacgatgtcttgccagaagtttcccacgctggtgacattgctactaccagatccgttctagacgaattgttgaaggaccaaaaggttgcttccagattcgacccagtcttgatctacattgctgccattgctgctgatttgattgatgaaagaatcatcgatcaacaagcttggttcactcacatcactccttacttcactatcttcgctcacgaaagaactgctaaggaaatcatcgacgaattcagaaagagagccgtcgacaacatcccagttggtccaaacttcgacgacgaagaagatgaaggtgaagacttgtgtaactgtgaattctccttggcttatggtgctaagatcttgttgaacaagactcaattgagattgaagagagctagaagatacggtttgtgtggtcctaacggtgctggtaagtctactttgatgagagctatcgccaacggtcaagttgacggtttcccaactcaagaagaatgtagaaccgtttacgtcgagcacgatatcgatggtactcaagctgacacctccgttgttgacttcgtcttcagcggtaacgtcggtaccaaggatgttatcactgacaagttgagagaattcggtttctccgatgaaatgattgctatgccaattgcttccctatctggtggttggaagatgaagttggctttggctagagctgtgttgaagaacgctgatatcttgttgttggatgaaccaactaaccatttggataccgtcaacgttaactggttggttgaatacttgaacacctgtggtatcacttccatcattgtttcccacgactccggtttcttggacaaggtctgtcaatacattatccattacgaaggtttgaagttgagaaagtacaagggtaacttgtccgaattcgtcaagaagtgcccaactgctaagtcttactacgaattgggtgcctctgaattagaattcagattcccagaaccaggttacttggaaggtgttaagaccaagcaaaaggctatcgtcaaggtttctaacatgactttccaatacccaggtactgctaagccacaaatctctgacatttctttccaatgttctttgtcctcaagaattgctgtcattggtccaaatggtgctggtaagtccactttgattaacgtcttgaccggtgaactgttgccaactgtcggtgaagtttacactcacgagaactgtcgtatcgcttacattaagcaacacgctttcgcccatatcgaatcccacttggacaagactccatccgaatatatccaatggagattccaaactggtgaagatagagaaaccatggacagagctaacagagttatcaacgaagatgatgctgaagctatgaacaagatcttcaagatcgacggtactccaagaagaattgctggtatccacgctagaagaaagttcaagaacacctacgaatacgaatgttccttcttgttaggtgaaaacatcggtatgaagtctgaaagatgggttccaatgatgtctgttgacaacgcttggttgccaagaggtgagttggtcgaatctcactctaagatggttgctgaagttgatatgaaggaagctttggcttctggtcaattcagacctttgactagaaaggaaatcgaagagcactgtgccatgttgggtctagatgctgaattggtttctcactccagaatcagaggtttgtccggtggtcaaaaggttaagttggtcttggctgcttgtacctggcaaagaccccacttgatcgtcttggatgaacctaccaactatttggacagagactctctaggtgctttgtccaaggctttgaaggctttcgaaggtggtgttatcatcattactcactctgctgaattcaccaagaatttgactgaagaagtctgggctgtcaaggatggtagaatgactccatctggtcataactgggttaccggtcaaggttccggtccaagaatcgaaaagaaggaagatgaagaagacaagttcgatgctatgggtaacaagatcgcttccgctaagaagaagactaagttgtcttctgcggaattgagaaagaagaagaaggaaagaatgaagaagaagaaggaattaggtgatgcttacgtctcttctgacgatgaattctaaacgaagccggatcttcttttcatttaaaaaattctccctttcgacgaggagtctcaaaaccaatatgcatcaaggcggattgcacgtctaatttaattatcgggctacccttcattgcatatatttataagcttactcaggatttaaacgatactttcacgtgcagagtaaagcaatcgcatcttcctgtgtaatcttcgcacattttgacccttctcaccataagagtgttttttttatttcatattatcccgcctttgtactgtttaatattattatatagtgctgtttgtttccattctataaagacgcagccttttaatttatgataaaaatcatttttcaaataattccaaccttctttctttccattcaaagtgtgttgatattttatcatcaagatatcgaaataaatgtttcgaacgatataacccatgcggacaatgttgtttttgaggctgattattttaacaagggtggcaattgcctcattatatgctcctgtgaacgtcgactgccccaaagacctcagtttaagagctgctaaagtatgtttaaaatacaagttttaatgtaacgcaaaatagccgccgagccttaatggctgttttaaaatgattaacgactaacaccaagaattccagaatgaaaaattgagtgcattggaatttgattatttatcgaaacgaactgaagtgattaaggggaaattcgagaagttctatgaggacctagccattcctggaataaatgttgatagtcttcagtttccacgaattgctgttgccatttctggtggtgggtttcgttctatgctcatcagttcagggttcgttttaggtatgcagcaacacggactctgggaatgcactagctatgtagcaggaatttctggaggtagttggactttactcaagctagttttggcggaattcaacgttgacactttaaccaaattcgatattgaaaggctaatgttggaaggtatccccaattttgatgtaaagaatcatgatatgatcaggcaaaaagattatagtgacgatgccaagaaatttgccatggatgaagagtttcttaaagaattacgccaacagtccataaatctcaacaagagagatgtgactatagagtatgaacctaattattatcatttcttggatgaagtatctgatgctttacttttcgaaggagatctcgggactgggttgcctgttttcaacaagcgctctttagatcctctctacaaaataaaaggtctcgttgaagactttttccaccaagaggaaaacgatcaggataaggaattagaggttataaacgaattaatggattcttttggtaagtttcggaaaattattggcttctatataaacttacacagacaagttcggcaaaagaaagaggcgggtttcccaatttctcttacggattatcttggacaagcgttattagataggcttcctgcgcagaaacaggatcatctcaagcagttatccaatttcgtgcaatcagaaagttttaaaaaatttgacgctcctatcccagtattcgtcgccaatgcaaagacatcaaagggacctgagttgcacaatgtagtattcgagtttactccctttgagtttggatcatggcatttgaacgtttccaaatttatatcaacaaaatatctaggatctactgcattaaaaggaaaattgaccaaatgtgtcaacggatttgataatttaggattcatcacagcaacatcatcgtctctttttaacaatgctttgttctatatttggaaaacggtaacaacaaacatagaatccaacgagaagttaaaggcaataaaaaccatctttggtgtatttggtgttggatttaatgccattcgatctgattacgcaatataccaaccaaaccctttttataaagatccagaagttctgaatttgataagtgacacatctcagctatttctagtagatggtggagaagatggtgaaaatataccgctcagatctttatttatcagcggaagacagaatgatgttatatttattgttgattcaagttcagacaaagagaacctacctgatatgacaaagcttcgagatacatacgatgatataatccatgtggaagaacaaaaaaggattgtcgcacttaagaatgagatttgggaaatggatctcatgccttatatcccaacctcagaggaactgctggcggcaaactttagtttatcgacgccgattgcgtttggttgtcatttacaaagctacaatacaaagaggttaacggatacattaattactaaagaaactagtagtgccagcttaccacctattctaatataccatgggaacataccaattacatttcagtcgaatacttccacctttaaattgaactatacgaaagatgaatataacggaatgctaaataacggtcatcatttattcaacaacgatgatactcagggagaatatttacaatgccttggctgcgtcatgcttttaaggcaaaaccaagagctcgtgtcatcattttgtgacgcatgcataagaaaggtatgctataactgaaaaaaaacgttcacgtgactttgtttccggacctcatgcttatctttcttaagcttctcagttttcgaactgatgttggttcaaaacgtaattttttgtttatacttttatgaaatggaaaaaatagaaaagatgaatcaattgtcagtatgaacaaagaatatgttatatgattcagaaaatatgcatctttaacttactgcgcaatttatgatctgatagcttgaatctatttactcatagcacgctactgtatttgaaacccaaaaacaagagttggaaagaaagagcataaaatactaggaaacatgcgtgttttttcagggtttgctaccataatattaacggtaacttttgctctactagcgaaagcagtaccagaaagcccacctgacggattatcatgggaagaatggcacatgagagatgagcacggtataacaaagtacactcctgaagaattctttgacattcatgatttaggtagcaaaggatatttggatgccaccgacattattaccatgtatgggctacacagagacaccatcgtaggtaaaggtgacggaatgggacagaacgatgagagtcaggtaattgatgactctttgcgtgaaggagccgttaaaattgtgatggcattgttggatgtagatgacgataccaggatcactcgcaaggaatatctagcatttgcagccaatgggaacaaacttgccgatcttggagttggtgtgggacatcatggtgatttcgaaactgaatatgagatgcatcattggaaccagtaccacaaggatcaagatccggacatcaagaacgttcacaaggaagatgtcgagcatgagttgctacaccacgaacatgaggtagaagcggctgaaaatggacctgtaggtgcagcaaagggtgccgtaatcactgatgatgaaatggagagcagaattgagcaagacaggatacccaagaaatttagagccaattaatggaaatatcacagctttttgtatctatatcgtatatactcagttaactcatgcatatatacatatcaaagggaacgcaacgtttcaagcaaaatatccgggtcaaaatggctaccgctaccgctaccactactggggatcgtaactgttgaataccagggttcagccttggatgggatctgaatctcactatcctgaagacggatcacgtgatccacccacgaattagctgacggaatggcatcctctgaacaggacaatgccgcttgtcgaagcgtgtcattgacaagcatcgtgtaagagacggaatctaatccatacgattcacgatcgtaagtaccattttgcaacaaaactttcttggcatggatatttttagcaatggcacaagcgatttcaggtacgattaacgatggcatcaaactagtaattaaggaaccgatactgtagatgatatagtctgcagattcaatggcttgaagggcagcaggatctgctcttggccagatcggagaaatggaaccgctatcatctagcacgtatcgaagctgctgcactgcggctgccaattgaggatgtgcatcgtttgacttggagaaatgcaattgagatgtgttattggatgagagatctgcaggatgagagatctcagattgaccagtgataacgtctccgttagcaagaactagttgcaattgtagagtgggaagaggatattcttccgggcggcgttctcctgccatatgttcagagataatgacgcatggaacgatagaaaagttcggcggcacgccgccgaactgcagaaactgttccaatgcagcatcaatcccagattgcatttccatgcttttaagtaggatattgccaacagacgctgcagagaaatcgaacttggaatctagctgctcaaccttggcggcaaatttgagaaacagctctctaaacataggatatagtttcaatctctgggataccgtaccttcttgtagcagttctgcccacagatggtgatcgccgcgaatcagactctcccattcttgtaaagcgactgttgaatccttatcgaatctatgatggaggaactgtcgcagtggttcatcctgaaacagtctaagagctctattacgaagatctccgagtgcgataccaccgaaacaacgtagtatctctgatgtggacccgccgttatcagatacggggatgatatgggtgacgctgttgccagcaggaccgtttggcgtttttacaacatcacgtgacaacgcttcaaagcaattgaccaacgaattactggcagtaccacctgtgaacactaccaccttcatggcggatggagagcaacaaaataattataactgcaaggattttgctatggaggatctgtcctttcctatctttagaagtgtttagatcagctggtaatcttgtttcgtatttcacatttgaaattatataaagggaaatgatatcatttcagaaaggttagaaactacataacaggtgagagcaacggaaactagaaagccgcttaacgcacctaaacgcacacagacgcaccaattgaagtatcagcaccatgaaagcagcagtattcagtgattttgatggtaccatcacgctacaggactcgaacgactatttgacagacaacttagggttcggtaaagaggaaaggctgaaagttttctctggtgtcttggacgggaacaaaccattcagagacggattcaaagctatgttggactctgtgcatgaaccattcgactcatgcatcgaacaattattggcccatatcaaattagacccaggtttcgtagaaaccgctgaatggtgtgctgccaatgacgtaccattagttgtcatcagtagcggtatgaagccaatcatcgaggcgctaattgggaaacttgttggtacggaacgtgctaaggaattagggatcgaagtgatcgccaacggcgtggaggtggacgaggccacaggtgaatggcacattgtgtaccgcgacgacacgcctcacggacacgacaaggctcagaccattgaacagtgcaagaagaggtttgctgccgacaaatacttctactgcggggacggtgtcagtgatttgactgcagcacgcgagtgtgacgtgttgtttgcacgtgaaggatgtgatttggcaccatactgcgaccaccatggtatcccatacatcttgtttaacaactttacagagattaaagacagaatagccaaggagctgtcttagaaggccagcgaactgtgtcttcggaatggtctgcgtcaagaacttgccgatgtttatctgaatatgtatcgctgtgtacatgttataataagaggccggattacacgatatatcacgtgacccaggtcaatggccaactcttcatcctgagttagctatgactcgagtcacgaaatatgagatagatgtaagttattctgtgtactcaattctacaattcccattctctcctacatgttacataaagtagttaaagattaacatcagtgaattatcatttatacgacttgacaccaaaaatataccatcaaacaataagatatagagtgtaaaatactatcttcaaaacacccccgtaactctaagcgttacggtcattatttcatccatttgtttaacagcctgttgaattgctttcttgataataactgggtgaatataccggcaacgttttcttcggtcgggatgcaattgaattcgcacaccctaggttgtgtttctctcttaacaccattgttctgatgcacgtaggctttgaaggaggtaatgaagaatcaggattagtgactatttggtatttcccctgttagcgtaaataataacgaatatattgctagattaatccgataatatcatatttgctgttcttctctcgcccattaattcatcatgtacgatatttgtgtcgtatttagccctaactgcatcaatgagatcatctatttgctcttcatctcttcaggtgactattatgccgtccccacttgtatcagttcatctacccaagtacagagagtccgtaattcgtaaatcgagtggggagtctccgcaattgtcgattgaactatgagtgatacgcgatcctcatttgtaagagatactgtatcaagagatttcctgattagatcaagattcagtgacttttacatgattactcatgatctcatatttgtgtttaggtttgttgttcatttgcgaactatgactgtgtgctttccgtttgccagtttcagcattgtcgaatccatcggtagtgatacagtgccgttagaactcacttgatacggagtctggcagaaacggtgacgaatctccaaatagggttctaatagtcatacgaggccttgacaactcgtcgcacgcactgtcgtctacggtatgtacgatatttgctataccaagaatatttgccgctttattcgggaattcgttgacctttcgaacgtataacgaatttcgaaattaaacagcaaataccgcagcatcgcactataatgtctccggtaaatttgcgcctgccaatagtatcctggcgtcatccattattgttctatccatccagacgctcagcttcaacatgtgcctattgtattgacagtgaagttgagccccagtgtctagcatgaatgataccattgattcttctttaccgtaagggcttgtaccgccttgaaccgtacgctttccttactttattattgccattgtaggcttttcctgcgttggtcgaggattggtatgactttgaactccgatgtgattgaaggatcaagcagcccattaattccatcaatccagtagcacctgctgatatgtaatgacaagtaccattcctatcttcacgatatcttaatccttcacagacttcagcaattagaatgctctctagattagtcaatatttttcggacattttctagcttgtatgaatcttacaagtcaaagccaaataaatattcttacagcgaagaatggctctttggcgtctagaacctggtttaattcttttgttaaccagtttggtggttcagtgaatttaatacatgatgaatagaagcacatgaaccaatgcaattgggctctattaatttttcccctgtctctcagagctgcataccttaatagattgtccattttgtatcggtgaaagtaatgatataagtcaatcatccttaactattaatgcctttagtctatacttcgcatagcagtctgggaatggaggggtaaaatggtcgatatttcgcccagttttttatcttccgttatcattgtttatttccatgatgtggaaggttttgaacattccttgttcagttacgtgtaacatacgatgttcctctgaaacgtgaacactggcgctaccatgctggaattgggtaatggtcaactcttaacacctgcatataaaagtagttaaaactgggagaaatacccgccaattgattatcatttatacgacctgttggcaccaaagtagcactttccagacccagatcacgtgaccgggactgtctctttccccttccccttccccgatggaaaaaagaaaatttgaaagaacaaacggaactctcaaaaacatcacgtgactccgtccgccaacggcaccgatagaacctcacccgccccccgggctcacaaaaatgcgcccgcaaacatccgaacacaccactcaaaccactcagacctcacagcttaactcaaagaaaccatagtatacctcaaggtaccaaagcatccacatttccggagtttcattcggagtgaccattgaactacaaattaatttagtagtttcaatggttaatccagataacatacagtacacatagcttaggtaggcccttaagaaccgaaagattccccgaaaataggtactaaatagctgttaaaacagcaaacttaatcaaaatgtaatcagtagcttatttgcactggatttccttttttcccacacggatccgttgttaacgggaaatggcgtaacaatttatttctggctcccatagtcattagaaactgatgacttttatcgctttcttgatttgattattcacatatttatgtttaagttctgtatatgtaagatatacaatatatatatatatatatatatatatatatatattgtatatatattgtctggggtaattgtatcgtttcaggttatatcttagattttggtattagtttgtgagatagatactcaacgcagttaagcatctttagcaatcaaatttagcagcccattatgtcaaagattagtgtcaagactcccattgtggagatggatggtgatgaacaaacaagaatcatttggaaattaatcaaagaccacttgattcacccatatttggacattgatttgaaatactacgatctttccatcgaaaaccgtgatttgactgatgataaagtcactgaacaatccgctcaagcgactttgaaatacggtgttgctgtgaaatgtgctacgattacaccggatgaggctcgtgtcgaggaattcaaattgaaaaagatgtggaaatctccaaacggtaccattagaaatatcctaggtggtaccgtgttccgtgaaccaattgtgattccaagaattccaaagttggtgaccaactgggaaaaaccaatcattattggtagacacgctttcggtgaccaatacagggccactgacgtagttattccaggagcaggtaagttgaagttggtgttcgagagcgatgactcgaatacggaaaatatcgaactgagcgtttacgatttcgatgaagagagtaaaggtggtgttgccatggccatgtacaacactttggaatctatcactgggtttgctcatgcttctttcaagatggctttggaaagaggtttgcctctttactccaccaccaagaataccatcttgaagaaatacgacggtaagttcaaggacgtgttcgaatcgctatacgaaagtcagtacaaatcggcgttcgaagctaaggggatctggtacgaacatcgtttgatcgacgatatggttgctcagatgttgaaatcgaagggtggctacatcatcgcaatgaagaattacgatggtgatgtggaatccgatattgtcgctcaagggttcggttctcttggtctaatgacttctgtgttgattactccagatggtaaggccttcgaaagtgaagctgctcatggtaccgtcactagacattacagacaacaccaacagggtaaagaaacctcgacaaactcgatcgcctcgattttcgcttggaccagaggcttgatccaaaggggtaagttggatagcaccccagatgtggtgaaattcgccgaattggtggaatctgctaccgtcaacacggttcaagaagatgaaattatgactaaagatttggcattgatcttgggtaagaccgacagatcctcatacgtcactaccgaagagttcattgaagctgttcacaagagattggactccgaatttaaatcatcattcaactaggaagaagaaagctagcctttccctatccgatttactgctacattatatatccataagatatatagccttaaaaacaatatttatatatcttcttcccccatagaactgacaccccatccgtagccaggagaattaagagaatatcaattaacctccgttggtccacatcacgagtaagcatctggacaaaggtgtccagtttatcaatccagtttataccgtttcggccctgtttcgctcgttcgcgatgacctgaattggaaaaagaatttttttttttcactctcaatatgactcagctacaccattcaaacctttgatccaccgttccatccttctatgaagcacttctctcatctgcttttgttctactttccccatatatataagttataagtgggtttttatatctgtttccactgtgtatattctttcttggttacacttcgtctctgttccactgaaaggttaacgaactcagtcgaaaaccttctttaagcaatgctaaaaactagagtggttcctctagcattgagaagctttgccagagcaaagtcttcttcgacttcggctcttgcttataagcaactgcatagaaataaggcaagacctcctttaccaacgatcgaaactccatcttggtctactaacagtgccatctcatcgatcctatatgaaaatccagtaatctcaaaggagccaaagaaacaacatgttttgaactgtttggttcaaaacgagccaggtgttctatcgttagtctcaggtactctagctgcaagaggcttcaatatcgattcccttgtggtctgtaacactgaagtgaaagatttatcccgtatgaccattgtgttgcaaggtcaagacggtgtcatcgaacaagccagaagacaaatcgaagatttggtaccagtatttgtcgtgttggattactctcattccaccatcatagaaagagaattgttgatgacaagaatctctttgttgggtgctgaatacttcgaggatttgattcatcaccatgaacaagatgaaaatactgataccgttgaaagaataagacaacagcaattccatccttccaaccttccactgtcccaagtattgagattgaagcatgaacatttaaacgacatctctaacttgactggtaactttggtggtaagattgttgatatcgctgaacaaagttgtattgtggaattatgtgctaaaccatcccgtatctctgcattcttgaaacttgtggaacctttcggtatcttggaagtggcaagatcaggtatgatggctctaccaagaacccatttatctgtcggtgatgaagatgatgctcaaagcaagatgaatgacatcgttgatatctctcaattgcctcctggttgatccaaagggctcacctgccatagttttgtacctcaaaacaatccaatatcaaaaaaatagtaatgtaagagtatgttttggattttgtctcacacatatagacaaattaaatacgttaacgatataatatggaattaacctttccaaatgatatatagtctctaaaaaactttcgtttttttcagtttaaactatgatgattgttgtggttcttttgttaatatgtacaaggctctaaatggtttgttacgtaacgacttggggaagatttacaatttgctcaagaaatcggtctttggtcttgtaatgacatctatcgtgttttgttcgtagttgtaacgtctggtggttagatttttcttggaaggtttgagtggttcttccaatttcttcaattctgtttctggtttcactggcttcaagaattttctgcgtagtctcacctcttcagataacgtcaagaagttctttgcatcagtaaacttggctagtacttgcttcttactgttcttgtccttaatatcaattgccttcaaatcagtaattagttgtgtctttagagtattcttttcttctggagaaatgtatttagttaattcaagcttgttgttaaatgacaatgattcattcaatttggtcgagacctgtttcaacaatgttagtttgtcgtccaacttagatttttcttggtttctcatcttcaatttaagttcttgttccaaatagtagtacgaattaaatcgggcatcggattcattgaacccattcttcaaacaagttctccatctgagcaaatatggtaatgcaaacgcaagttcttgttgatccagctcaactttcagatctgaaattatcttgctgtattctgccttcaactcttcacgtttaatctcacgttcttgctgtttcttgatcaattcatccttcagcaaataaatctttcttggtaaagcgttctcttctgcaatggctttctcttcatcctcaatgatggccttgccgaatcttctcaaacgtggttcgaaatgcggcaaaggaagctttacatccttgtataatgatacaccaatgaatttcttacctggatgaaatggatccaaatagtatctcacataacccggctccaaagcgaaaagcgtatgatctttaccgatgcctacattttcaccaggataaaacttggtaccacgttgtctcatgatgatctcaccaacttgagtggcttgaccctcgtatttttttggacccaatctacgaccagcagagtccttcatactggtacgagaacctgctgcacgcttggttgcagtacgcacctgctgcaccacaaacttgggaacttgttgccacgaagatgagaacattatgcgttgtttcgtaggcctggtccgaacagtatcaagcaatgtcacagtaactgtatttctgcgtgtatctgtacttaatgtatttaagataggattttagtgacaaaaattttccacagtatggcggattgtaaggtagggtaacaacgaaatccaacaagatatagcccttcgaaggttcgtgtaactgactgtttaagagttgaaagtattgatttatacattttaccaatttcatctattgctgagagttctttcgataccatagtgaatttttcatgcttgagaaggagtaaacgtctaattcacgtcaaagttattcgaaactgaggttccaattaaagatctaccatcactatatacgttttgatgttctcttccagcacgaaaaactcatatttctctaagtacaaaacatcaagaaaccgacactgcttgcatcgaaaagaagtcttcacctttcagatttacgtttgaataaacaggacgtccatttatagaagtttcccaaattaattatcgtgctggtgaagcccatattatctaattgaaataggaatactaagaaccgacagcccatagataaaaaaaaaataaaacaaaatatatcagtgattctagcgaaaatggcaacggaagatagatggggtcttgccgtgactcaattacaagatctatataaaataggagatattgcggggtttgagtctttagatccgaagaatatgaatttccagaatatgaatttgaatcaattggctgatatccatgagaaattagaggctcgtcagtctgtaaatgaaaagatgagaaattactgcagagatttggtagagaacatttcatacatattagataattatccagtggaagaggaacctatattaaaggaggaatccagttcgacgcatatccctgaatcgagtgttgttggtagatcacattggaccagtcaattcaacccaagtgaaccaattgaggttggttccgaagttgcatataaatctaaaaagactggcgaatggatccagtgcatatgcacaaaagtttctggggacggactccggtttgaagtgaaagatccagaacccgatgaatttgggaaaccaggtggtatattcaaatgtaactcgaaagagatcctcttgatcccgcccgtgactatgaaaagaacccagactccgaattatccagcgaatacaaaagttttggcaagatatccagaaacaacgactttctatccagctattgtttgcggaagcaaaagagatgggacatgtaagctacgattcgacggtgaagaggaaatagacaaggagactgaggtggaaagaagattagttcttcctttcccctctagacgatgagtttcttaattatatcacgttcacgaaatgtatgtaattttccatagcctgtaacaataaagaaaaaaaaattatgaaagaacattaaataaaccgtatcacattgagataatgtaggaactagtagcggtgcctgtttgtgatttatcgcatcagacgcgacagacattaaataccatagttctagtttcttattgtcgaatattttgtatatgattcatggtgtacctttttaacaaagtgacacttaaatcaataacaaaactgtgttttgtgctattgttagtgaatctggttctaaaactgatgaaggctccaattttgcctttattattccggatattaaccacctgcccagcgaacaaagatgtatgtatcttttggtggcagaagtattcgatagtagaacaatgggtatggaggttgattgattatattgattcagagagacttcaggttccacatgaacaagtttaagtcaccatttcaaagtacatctagtaaatcgtgattgctttgcagtaataattttgtaagtgtctcttacaagtcagtgagatatataaatctgtataatattatgtttgtcattacagaggttgggtttgtgctgttgttctaaatatcagtgtttagctcaacaccaccaacggtccagatttcattttcatcttcaaatctatcagagaacatcgcctcggcatctccaccggctgcaatcttgtctctttcaacagcagctagtctcttaccaactctcttggtgtaatctcctaaggatcttagttgcaaagtgtcaccaatactgttttgtatggtggatccttcgagtttcgagaaccaggaagtgaaggtttccaagttttcttcttcaacaagatggaacatggctaagtatgccttttctgcagccaacttaattgggatcactgtgtcacgcaagcacgagaaaacagatggagcgagtaaatcgtagttgttttcgatagtttcagcgtacttaaatcttgcaagcgttcttaccacgaccaaagccaatcttctactgtctagagaattactgttaggtttcaacatacacttagcaagttgagaaactaggctgttgatattgtctgtgccaagatggaaaggttcactagcatcaagtttggaataaggtgttcttgtttcgccttctaataatagagtcttaccaattgcgagtaatccattatcactgaagtaagcatttgatgagtttgttgcatcaattatgtagttaacacattcatcaattagtccagtgccaaaaacatgtgatggagcatctttcaagaatgagtttagggtcaaaataccgaatttaccagaatcttcagtcaaggagctttctaacaccttgcttttcaatattgttgcagcttcctcggttgataagatacttgataaggatccgattaatttcgcgtaggccactgcgagcttatcatttgcagataacatttcttcttcgatcaaatttaagatattggtttttgaggtttggttcaatttggaacctgcctttgatacggcttccaataaagccttcaacatagcagtcttaacaccatcatcatcactttgcttagcacctgttaccagttcgacaaccaatggatcaactctaggctggtattcaattaaggttcctaatgccttggcagcacgaagacgtaatacctcattagttggatcggacaaagatttgacaaacgttctttgcaactgaggaatgaaaggtctcaacaactgaggaattttcgcaaataggatattcaaagcataaaggatagctgccttgatgtcactattgaatctttctccaacaacacgaatcaaaggaccagtgataactgtaacataggatttcaagcctgctgcaggagtcttggagacaatatccgcaatggcaagggctgaagcctcacgttcgtcaccagaaccatacattaaaccatgtaaaaatattggtaaaacacaacttggtccctttggcaatttgaaagcagctaaatcttccccttgtttaccagtcattaacaaagcctgtttagctggtttgattaacttctcgagcattgacttgtcctggtttttcaccaagcttgttaatgcgttgaagttagcctcaacaattctaggatcggattcatccaacgatagaatagcatttgtagcgatatccgatgtatagatgttgtagtccaacgtagtgttgtcaaagaatgttggaagacgctccaaaactacaattctcttagctacatcttcgtgctttaatagtgacataatttgttgcaagagtggatgtaaaccttcataatctgttattgacaagaaaatcttgtccaaagtagattcaagggagtgttttgtttcagtgttatctgtttctatcaaagcattgacaactgaattgattattgtcgaggtacgtttgtacaatgcaggtccagctacctcagctaatgaacccaatgcgtttgccttgaaagcatcgataggaggagtcaaaagagttggaattaaaatagggaaaatcacttctgatttagtagacatgatttcttgcaaagcagataaggcgtattgtgagttttcttcttccttcaatttgttcaacaagaatggtataatttcatcaattgcaaccttacccataacttcttgatatgcatcgaaacaagttgctgccgcttctctgacggtttcatctccatcaatgacagtagaacagataatgtcaacgataacagattggaatgcctccaaggagtcactactagaggaaacaattaattcatgaagagcgatacaaacaccttgcttagagttggaatcaattgaggtatcgagagattgttttagagtaggtaacaattgcgacaaagcattacctcctacccgacgaaccaaatcacccaacgtctgggcagcaatgattctaagagttcttgatgatgacgccaaatggatgacaatcgttgaagttaattcgggtagaatctccttaatagtacgtggggtatttggaactaatgccttccaaatatcgacagttgtggcacgaacaataccagaaacatctgaacgacatacaaagagagcagataatattcttgcacgacgttcttcacccaacacttcgaccatctgtttactaacctcgctattgtattctgcatcttcttcgtcgaactcattcttcgaagagataccagtgacttggaataacaagtcacccgccaattggacagaagatagtctgattctttcgttttcatcgaacattccattttcaagttcaggcaatagaagatcaatagcttttgtcgcataattcttgacgatcaatttacctgccttcaatgcagtgtcacggatattttcatctggatcagccaatccagataaaattggctgaatgattttgtttatgtacggagcaaattgttgaccgaagcaaacaggtaagaaaagcattagaggcatgaaaccttcacgaacataagcacgataatttgtgacacctgagaggatagttggtaacaactcttccaacttggaaagacctaatccagagataacttctgccaatgcttgtgctgagcccatacgatcccctgatttagtattatcgcttaaagtggacatcaaacgaggaatcaagtctgggaactgttcttcacctaatctttcgactaaggcacctaatgcacgtgcggctgtggctcttgtattaggcacagggtctaccatagcaatttctacttcatcaattagttgttgtaagtaaggaaccaaatctctagtatcaacaaggatagccatgttaccgacaattttacaagccttcctcttagtgtttgcagatctgtcacgcatacctcgatgaataacgtggataatcaacgctaatgaaggaccatcgatgtaatgaacaaactgtgtttgaatcaaggcatctagtgcatcttctgtgtattttgttggatcaccaatagcattaatcaaagtaggaaccaatttctggatttcagggtttctaataacttcaccaaatctattcaaagactcgtcagcggcctttctgacttccttgtgggtatcattcaaaacacctacaatttcaggaacaatggtagacaaagatgcagagagttgagtgggatccaaataagccatgttacccaaaagctccacagaacctctttttgttctccaggatatatcatcaaggttagaaacagcaacaggaattagtttcttcacaccaaagcttgtggtagatgacattatagccttagtggcctgtgctgtagcttcgcgtacttcaggaactggatctcccaaattctttagaatgttcggtagaatctcaatcacgtatggctcgaaaaacttccctagaacaagagataggcactcgaacccatatgcaaccgattcacggcagcgtgggtcttttttatcttcggatccttcgattaagctgcgaataacatcaaagtctgaaagagcagaaataccgtacccctttactaaaccagcaataccccaagcagcacctcttctaatttggtttggtgcaggtgagtcaaataatgcttgcaaagagaagtcaatgtattcttgggcagagctctggaataagggaaccaaagcagataaacattttgaaattgatttttgtaattcttctgatggagtttgaagggagcttaacaaacgctcagcaatggttctaattcttggatcatcttgcttcaagtgtctagctagagaaccatatagaataacgacattttctttcatcaaaacatcagtagaagaagacaaaaagttttcaaatattggcatcaaatcttgcaaatacttactaccgtggtagttaatgatttcgataccagcttctttcatctcctggcgaacaatttcctctctatcacctaatgctccagaatcaatgaggaaatgtacgaattcaacaacagcaccaggactggaactaaatgcacggcaaagttctttcagtgcaatggcagtagtacttcttgcttcccaagggtccttttgctctgttgcactgattttaaccaaaccgtagtcatcaagaatatccttaggaggttctgacttcaaagcataaaagttcaatagttcgtggaagtaacggttgaatgaatctggattttccaactgcaactctgagacagcagatgcgtacgccctagctgtgaagagtcttagaccactatcctcctgttcaaagaaattcaataaatcgttcactagctgatccataactttgaattcgtttgatttccatatgaagttcgcgatgtccctattattttcatcttcattaaagcaagtaatataaacttcaggagagtattccataagtggttcgaggtcgtactcatcatcaagtgcctccaacacagtcgcctgaacaaattgatttgaagttagcaagcttttcaataaaaggcataaatcttccttagttggatgtattgatatattttgacataaagagatgaaatactcctttgccaattttgccttggatgggagagccaaaagagataagagaactgatactatgctttgacgagggatagatgtatcttggaatgcttcgccatgagtagatatgatatccaaagccaaaagtagctgttcttcctcaggatcttcttccacaaactcgctacgatttgtaggtttattagcattcttgattgcaacttttttaccgatttccattacttttacgagtagtggaaggatataagtcaatgccatagattggaaaggtatttgtctgcaaccatgtttgattttgaataatgcagttgaaatcagttccaatttagtctctgaattcagatctgaaagaagatgaggaactctatgaactatcatcgttgcgtaaccaacagttttagcgaacattcctaacctatcatccaacaaaaaggataattgcaaaaatacgtcaaatccgagtgatccaaatagcaaataaaagtttttctgttgtagaatatctaacaacgaattcacagatgtggggaaccaatatttgataccattatccaaaagatttgcttcagaagccaactgagaaatgatatcaataacgcatttcacagataaaacgagctcattaatacttgatctaacatttgattcctttttcaactgttcgtcgacaatctgttgttcttccttgttcaacttctttgaacctttcttggcttggtcctttcttatactttcttgccattttagaatttcataatcctttgaattcttgttgtttaagatagctgattgttttgcagagagtacatcgacgacaagtgtaccttcttttccgttccagatttcaatttcttgttctgtcacagcagatagttttgttgtatccaagtttaattgaatcatgcttgctaccaaaggtgaggtgatctcaggattgataaatgagaggtgagaaatggctttaataatggctcttcttaattctggtgttgttttatcagcgctgttaagcaaatacatcatattgtcgaataatttctcaccgtattgtctcactatttcagaaggatccaactctgcattaaggactaagccagcccatccattcttcaatttaatgccgtctaattgggataatactaacagccttgttaacaaatgtacggagacagacttatccgaaagtttctgagatagggtattgaataaaggtgctgcaaaacaaaatgatatacgcgaaagagtatcattcttttgttttgacaaagtttcaaaagcatcaattattgcattgccgacaaattgtgggttcctgtaaaatgcgcagtttagaagctgtaaagcttgctttctctgttcaaaaggcacttgcgtggatagggtaacatatatccaagaaagaccgtatgactccttgtgtgcttcaaggatgtcatcgattttggaaagtattgcagttgcactcaagtcaataagatgttgaatgtaaacgaaacatccatatgctgaaccttctccattttttaatggattattacagacctccttcagatatgcaagtgtttcgtcttcgagctgaacaatgatatttagttttgcagtgtttaggttgcttaaaaaagaattgtaccatatctttctcaaaggtaacttattctcattaaaaccggactttatggcagcaattgaaacttcgtctgctgtttctaatgaggacaaatggtggaaaaatgctgataacataatattcaatgctgtctcattggattccttcgaaatataagttctcaacccatccacgatttttgaagacacttgattggagaaagttggtacatttattaacaagttggatataataatcttatagtcggtattcaggttggttttcatgttcttaaaagcctcatccacaagtttttgtaaagatgattcgtcacaggaatcagaacatattgacctcaataatgatattagggacttcaaggagctttcacgtacgatatcttttgagcttttgaatgatgtaaaggtttgagtaatgcattttgatgaaacaaataaacccaaactattaactttgttagaattgaacgccgaatagaattcagcagattgggtgaaagatgtttctggtgatcttaaatttgctttctcaaagcttggaatcaaatgcttctgaacttgttcttcagtaacaaatgaatataggaattctttcaggaaaagttccaaacagaatgctgaaggcaactctttggcgaggataacttctttaccgagatactctactaatctttcagtcaactgttccagcgaatgcaaaggaattggtttcttggcttggcactgtaatacagaatgaactagggatcccagagtgataactacaccagtatttggaagcttcaatttcgagtagttgtctaataacaatggaataacatcatcaacaatattagattttgaatctgtagtagattccaggttcacacaactaacgaaactcttaacagattgttggaagacacagagcctcaatctcttacgatgttggttttgcttattcaaatctttcttaaaaggttcatgggtatctaggatagtctcgatagctgctacaagcatcacataagcgtggactatttctttccaataaacattgaagagctcatctgattgttcataaatcaaattcaaaaatttaagcacccattccaataaatttaaataatcagtaacagctttagaagggcagttttgagtgctggcagtcttgataacaaaatcacttatctttttacaatagatggggtcggtttcaaacaattggaccaggattgaagtgactagaacttttgattctttatcctgatataaatcataagtgcttagtacgcaattgaaaatcaattccaacgccgagctatcagttttacttttatcgttggattttaacagttctagggcacttcttaataccggtagcctgactgtcaataaagaagcgtggcagtctctgtaaagaacaggctctaaattttcccaagtagacatccgtaaatactgttgaaaaatgagatgagacttctcaactatgtcgtacttttaataaattaagagtcggtaattttcaatggcttgccgctgataagcgtctaaaacaacattgcttaaatcacaactcatctctgaaataatgaactctgctcttgtttaaaaaactattcaagattttaacatacaaatctgaaaagctttggtgaaagaaaaaaaaagtacaagatcaaaacgtacaaaatgatgtattgtaactaacttgaggctaatactatacttaatataattagtattataatcatcccattgatatattaatgggcatagtagttcgcaagtgatactttctttaatgtgcgatttgtagcagtttcacattcagttatcaattggactttccacttggttggacaacacagagtttgtccagaaaattactatcattttctatgaagaaaagaaggtacgatattatttaactatactgacgctgcatgatagtgactagtatggttgaaacaaaataatactgaaaactttcaattataatacataaagtcatataatgtgtaaggtcaagtctaaacttatcgtgttcaagacttgttactttggttagtcttggaccttccagtgccaatagtcaagtttgagattgtcttggtgatcttttcaaaagatttgagatttggtgacggtgacggtgacggcaggtgcggattactatgtgtgtgaagtggaagatgaggagattgctcttgagattcaggtctcgttattgaacgcaaagttggctgtcttctttgtttcatcaaagtgtcatcaatttcagacatatcttgtgcaagttttttcttgagagttttgatttctttagaaatatgcaagcagtccttgcatctaaccatcaatttcacgtcactcactaagactgcagattcgtaaattagttccatgacataatccacaggtgggagtgaatttggtgaagcaagactatctaaagtggataacttctggttgtggtacggtggatcatttctgactttaccgctaaacaaagacggtttcttcgtatagttagagccagattcagtcgatcctcgagataagggatcaactgaatcctctagttctagtgctcgttctctgaaggacctctctattttgctcttagaaggtagagaaagtccaacacctagatcgtcagagtcagaaggacagcttgaatcgttcgtattagatttttccaaagcgtcatgctctaaaatatctcttacttgatcaagttcgtcatctatgttgtgcatttctgtagttgtatggactgggcgtgctggtgaagaagagcgtgtcaaaatttcaggagaatccacagtagaaacttccttgcttaagctcgatttatgttttggatttgtattgattctttgttgaatatgtgagatcgaagatttcttcccggatacagtgatggtgcttggatagtgggctgatgatattgaatttatgctatcccttggacttccggttatcaccgaaggagtaagggcaggtgcggaagaagaatcaaaggaattcaacttatcaagatgatcttgggtagcactgctactaactgtactcaccgaaaatgctgcagacgcctttcgcaaatgatctatatcaaagtaaccgtcatctatgctgtttaacgatttttcaatagcctggtattcctggtaatttttgtgattttccaaatactgttgcatagcatcttggtcatcttcaaaaagcagtgagactcgattgaggaaagcatcttttagagatttgctaatcacaaacaagctttcctctttcttcccgatgatagaataaaatacttcaagcattagatcgaagagcaatggcacttcataaatcttagccatattcaataatcccaccgccacaggtgatagaggccatttaccatcaatttggccagtgaaaaaaaattccgcgaacgctttaacagtttctgtaggccaaggcatatataatgacctaggtatgaatagaggctcgaaatcaacatcgcccgaattcagagtttgactggtcagactctcagtatttgaagcaaatgagtttcgctcgttttgaggggtagtcatgccatcagcttcgttatctggtttgtgtaaaggatctccgacaaatacctcatcaattctgtttggatagatattctcttgtgatatatgttgagaaatatcatggtgtaaagatgatcttctacttgataatggagaagttgaagttcgatagcgagtatccggaaaaaaatgatccgaaagtcgattgtcaacactaaaatcatgcgatgtatgtgtaggtagcgcagggagcggttcacttgggacaggcagtaatggtggtagcgaaacattcagactcagtatttcttcagatcctggacttctgtaaattgactctcccattctatcgcttgaagagctgacacgagaaattgaacttgacgtagaagctaatgaagctttacgggagcttaatggactattcagcccaaagcttgaatgaagtaaattatcattccccagtgactgagagattctacgagattgagcttggctagatctcaggaaatcgtcagtaaagagagcagagtatgagcttgcagaatttttcctattcgaaggtacagatattttaattggttctgaagtgtcattaggatctaagctaataggtggtggtgttgatctcttagagctttctccgcttggcctgaatggaaccctaaataccatgccaccggatgaactcgttacacctgaagcagcgtttgaatgacgtctctgagaagactgctccgatatttctcccaaagagactatatgatcaggatttactcccaaagaggtaggtaatctgtcgttggcgttagtagcggttgctaagctatctgaatgagaagctatcgaatgagacgagttatcatttgttaatttagatgtgcttggcgtattgaagaataagcaagcggatttcctttccattggaggcgtgctgctttgcacagactgtgcacttggtctgtggcggctaaaaaatgtgtccaaagatccttgtgatgttggcttcttgtcatccttagctatggaagatattgaactagatgtatgcggcgagacgcctaactgccctacgtttcctgaagaaagttttgaaatctgggaaaagctttccggtattttgcgatctgttgaaacttgaacataagcattagccaaaagcatatcgaagtacctaccccatctctttctaagtaaaaaacttggaacggcgacagattcgtcatcttccgttatgaactcaaaatctgctagtagcttgttgtagacttccaaagaatctttacctaaaaccattgaataagatgggaagacggatcttatagatgtgatttcagatggtggggcaacatatctactgtaattttcgaactggtctgtctctgtttgagccaaactgcccggtattttctttgcagaggatgatttagaggatttctgatctctctgagcagaatggaataaattagtgatatgcaacccgaaggaaagcagtctatcaaatttttgtacagagggcaaacagccagaatcatttttggtaccaagaagcaaagccttgtgatgcgattcccataagaacaatttccagaatctatgttttgagctatgtatatcatcgcagttgatactcaatctagtccatttccctgaagtgatgttgtaaaggaaacaatgaaaattgtctgactgtaagtttggatggaaaccagatattatgatgttataaccgaatttatcgccggtgggccattgcaaattataggcgatatgtaatctttttcttcgtctatcgttgtcatcatagacgtgcattctagcaccttcggcatccggcattaaaggtaaggcgaaaagtggattctcttcggagttgaaattgcacttaaactcatgatcatgatcatgagattcctctattgagggagaatacacagccaacgacggcagtttagcctcattttcttcaaccaacaacgaaaagttattttcggagatgagaggaacagatttgcctccgatattaactgttatattatgtaaatcgtcctcttcgtcccacacatccgtttcccaacagtttgtcgataaattgaaaatgtcaatagtttcaactggttggtccaaattattcaaaccacccactataattaacttggtgtccttctttggatccgattcgtacaagacatgcatctgattattgaatcttcttgtcactgacgggtccttactgattaatgaccagactttattatgtaaatccaatttccaaagttcattagtggaaataaactcataatcagattgttctgaaactgtcaaaccaccgaaaacaaagatagcctcttgacaatagcatacagaatgaaataacctctctgtcaaccggggcatcggattacccatgggatcagtttcaggcatagtttctacccgttcccaacgtcttgaaatcaaatctaaaaagaacacttccttacttatccattgtcccaggttttgaaatctatttgagtccttcctttctcgggcaaaatgcataatcaactcttgttgtagattagtagatgttatttcttgtaaattcaaagggattgtcaacccaccgtgcacgaatatccccgatctggcaagtactgttgcagcaccagttcttacgtccaatgtagatcttctgatggagcattcatccatactatccgccgtttgagcatccaattgcggtaggtgtaggttataacaagaacaatttgagggaagaagaaacggcatattctactggaaaaaattttttgaaagtgaagtttgtatggttcttgaatcgatgtgacagctattgaagcagctatttgctatgcgtatcttgtatgctcctggctgactagcagaacccaaaatatcaagaagggccaacaacagaaaaaaggaagatggctcccaattactcaacaaaataaactctgcagttttcgtaccgaaacgtattagcactgatactagactatcgatatcttaaggtacaatctgtggttgatggataatacagcttgttctccctctttttcctttcaccgatgcttttgatcagaatgggattctggtaattcctatttcaaatcctttaaatttcatcatcattttgcagtaaaagaggccaagggtgcagcttttaatagaaaatacagaggagaattaagacagaaaatgataagagataattgattggtgaaaaggtccttgtacttcgaagcatgtttatatatttatttacaacaggtttataaagtggatagtttgttttttttgggtgcgtgcaatgcggccgattcaacaaatcacagataaccaacctagcgttactaaacataaagccaatgggtatttttgaaccaaagtctgggatttcgatactttccacattgatattattgaccatgacgaacatagtgcaaacgagacgattcttgctatcactattagtcttataagtgtaactttagggatcttattgaataaaggtaagataattgaacatgccaacgaattgatcacttgcgggaacatgcaataacctgcaagagacaaatatgacatccaagacattggttcatgtggattcaaaagtttcaaatgtgtggccatagcactgatcaccagccaacaagtgatgaaaaacgaggaaaaccgtccacgacccttggataagaacaacgagtatagtataatgaaacatagaggggcccagaggtcggtaccttggaaaacatgttgatcttgagcacttggtgaacccaatgggaaatgtgggtagactactttctttaatttatcattgatctcatggaaatctcttttgaaagtggacacgatactttcatctaacgttcctctagcagaagtggataaagtggaaccgtaaccgttaccagtctcagtttcaataaaatctggttcaatggtgtccataattggccttactcgctgggatatggtaattaattgtaaaaaaagaataaaatagaggtttttacttataagtcaattcagaaggaaggcaacatgttttttaatcctttgatacaagcgttatttgtatcaatcagagattgttcacgcatagttattcatcatttgagattcgaactgccgagaaagtaacttttttttatttgtcacaacttcggttttctggcaattcgcgcagaccgcctggtccgcccactaagctactgggggttaataagaagcaaggtatttcttagaggcgtttgcccgttatgttgtgagagcctatcacgagacgtttcccaaactgcaagaataaacatccccttcgaccacagtgcacggttccattacgccattccagcctctagcatttcctggttcaatatcctaaaacgacaaccttgggagacgtggtcatcgctcattgttaccctggtttcgttcataacgatttccctctttccctcattttggtctcccctatatcatcactatacatcatttctctaacttatcgggtagggcagaaccaacgaagtgagaacacatccaaaccaacggattctatgccttggtgttgcccgaaatagcaaggtgcggtagcttattgtacgcccttgttttatttactatatgtattttttcatgtatccctaatggagaatgtaacgaactgcagcctgccagctctttacatcttgattctaataataaatatggtaaacgagtggaaagagaagaagagaagagaagagaagagaagaagagaagtaggcaaagaaggcaagggacgtaaatgtcagaggctgcgtgcgcgagctgcggtgcgaaatgctaggcagaatatagacactgctactgctgctgcgcagcagcagtagcagtagtagtagcatctttgccatcgaaacccgacatctctgaaatacctagcaccctcccgctcacaaacaaaaacagaacacaacccattccataactaaatagtacatatacgacacttggcaaggcaacactgggcactagccccatccctagccccagttggttttccagtccaatgcgaagcgataccaagctgacactgcgacttcttttctttttttcccatatgaaggagaacaaaagtgaaaattgagaattgaaaactttcggtaacgctttttggcattacttacaacttgtgttttattcattgggaaaacacggtattttcagtgttttccttcccatttgtttccgggaagatcatcagtattggcgccagctcgagtcaggtcagtgtgtggttattggcgacaggtttgaacacaatacgaaacggtgtagatctcgtttttcgggttattttctaattctattttttttcctttaaaactctgtgtgtgtttttctattattttttctttcaatcaattgattaaaaaaaaaaattaatattattaaagaaagataattataaaacataagagattgagagacttacgttcatacgaaggttagaaagaatacagcagggtctgtttgtttgtagaaattggaagtgagacaatattgcatcttcaaaccagggtaatttctactagtacctttttttatcttttaaagttgcgggctatattctataatctgtttgcttcgttaggaaaaaaaaataaggattaataagaaccaatacttttggataatccaagacacggaagcatcacagttgccatcggttacttcaattattaagaacgtttgatatagtaccgcgataattataaaacaaaggaacaaggaataaaataagaaaaatggatcaacaatcagtagacgttgacgatatcattgatagattgttggaagtgagagggttgaaacctggccatcaggttgacttggaagaacacgagattaggtatttatgttccaaggccagatctattttcatcaagcagccaatcctattggaattggaggcaccaattaagatttgtggtgatatccacggtcaatattatgatttgttacgtcttttcgaatacggtgggttcccaccagaatccaactatctgtttttaggtgattatgtggatcgtggtaaacaatcgctagaaaccatttgtttactgttggcttacaagatcaagtatccggagaatttctttatcttgcgtggtaatcacgaatgtgcatcgatcaatagaatttacgggttttacgacgaatgtaagagacgttataacattaagctttggaaaacttttacggattgtttcaactgtttgcctatcgctgcgattgtcgatgaaaaaatcttttgtatgcatggtggattatccccagatttaaataccatggaacaaatcagacgtgtgatgagacccaccgatatcccagacgtggggttattatgcgatttgttatggtccgatccggataaagatatcgttggatggtcagaaaacgatagaggtgtctcgttcacttttggtcctgacgtagtgagtaggtttttacaaaaacaagatatggaattgatctgtagagcacatcaagtcgtcgaagacggatacgagtttttcagtaaaagacaattggtaacattgttcagtgctccaaactactgtggtgagttcgataacgctggtgctatgatgtctgttgatgaaagtttattatgttcgttccaaatcttgaaaccagcttctaagttattggaacgaaacgtagtgagaagaaagaaatgatgaatttaaatttaaaccttcttaatcatcatcatcatcatcatcatcatcatcatcctcatctctcccccccctttaaacaacgaatcccatctcaaagaaaatccccaatgaaaaaaccagaaaaaaataaactattaaattcaaacataaagtataagatatattactggaaaaacttgctgagctagaacgttttcctttatacctttctaatatattgtaacataatttctttgtcgaatgtcaagcgggctgctacaatttcaatttcaaacctttatctccactttactctcttatcacccttttacacatatcccatcattcatgttattagtatatatatacgcagtgatatatacatatatatatatattctacatattgcaaaggaaaattctgtagattagccgttgagcctttttccatacatcaatcgactaaaccaataacacgtacgttaacatagtgctgtagacacatcgtgttttttagcatagactgaaaattttggaaaaccctcttttttcgatctttctatgtgttatttttttttttttttggcaaaaagttgaagtcgtgttttatttgacgatctgttacttacatgacatttgtattcacacacttcatcgagttgagtcccttcatctttgttattgcactaccctcaaccgtctagtgaaaaacaactagtagccagagagtccttacatataagaatgctattacaatttttggtgttactatttgctggtttgtgtaacgcacacacggtacatctaccagcgtacggtcgtcgttgtttctttgaaaacttgaacaaaggtgacgagctatctgtatctttccaattcggtgatagaaaccctcatggtactgaacaattgactggtgatttcgttctatatgggtctcaaagaagcgaggtcttgaaaactttgagagacgtgtcacatggtgacgtgtttgtgaacgctccatacaccggcaagttccaatactgctttttgaatgaaaactcgaacattgacactaaggacgtgactttcaatgttttcggtgttatttatgtcgatttagatgatccaaacaccagatctttggacggctcagtgagacaattgtccaaactggtcaaagaagtgaagaacgaacaaagttacattattatcagagaaagaactcacagaaacacagcagaatccactaatgaccgtgtcaaatggtggtctgtgttccaattgctcgtcgttgtagtgaattcgttgttccagatctattacttgaagagatttttcgaagtcacttcgtatgtgtaagtaaaacgaaaggcatggctgcatgaagtatatcagatatagtcgtcgtgtatattcaaagtaaaaatatgtgtatatgtatatccaggtttttcctctagcgcataagtatatcatattagaggagtaatccctagggctggaaattgaataaagaaaaaccttcacgtgatcgcctcaatctgctatcatcttcttttttcctcaaatatgtttaagaaagcaccctgtcgaaggagtgtgatgcttggatatgtggctccggttcgaaaccgcacagtcacaccgggtctctttcaaatggaagaggtttcacaatggtatcccaaacaggcgtgaaatgtctcgtagtggttatatgccattacccgcttttcgtgtctggccgcccggtctacgcgttcatttatttgtgtaactgctttggacagctggatctcggttcggttgtcacgtggtcgacgtgtcccaccgttacaaaattgttgcgggttatcctttgtggtggctcggtcgcatgagaagtctgcggttcgaagcccaactggtaacgatttagcatttcaactaatacttgaagctagtttagtgtttaacgttgtaggggagtctcatccagcacaacgaacactgcccgtgacgaggtggtgtggattgcacgtcccgtggttaagcagtgcgtgtgggttcagaggcagacatacactgtccttcattttttttggctgtacttagaagtatgttatatggctagcgtcgtgcactgattcatcattcaacaaatactccagcgaagctgcactgtttgtctagtttaaatttgaactatctcactatgttaaaaaattgtgaattgcacataactacaacaacttctgtttccccggttcatactatacacagccatttagcattccaaaagcatacctccaatgaacgcaaacgtatatgaagcaagccataacctcgtcaaaggtccaaatggatcaattctttcaccggatgaatgccttggtttaaggttgaaccatatcgttccaatcccattattgactagagacgaattacaaacgagattacccactattgatacgaaagtggtgcattactttttgacacaactcatcttacaaaggtacccgcatctagtgaaacgattcgatgagaccagtctcatcacaattagttggttattggagaaatggatcgaagattacttagtgctgccggaaactggatccgtgtctgaaggggtttctcaacagattagcaaggatataaattacagatactcaccagctgatatttagaggtaatactacttagtgtgtgtgttttacatgccttccattgtgtacctgatccagtctctctatttacataccacgtgacttgaaaattttccgagactttgaagaaaagaaaaagtgaaaattagaatccgttgatgatgcgatgagatgagcattgtttcctgtcagatacggtcttgtgtgtcttgctgttgggtttattcggttctctcttaccagaactagtgcaacatacaagcaggagaaatggctagaagaaagaatcaaaagaagggaccaaaaaagacttttggtactcgtgatgactccaacaaccaaaagaattggactgaattagtgaaggaaaacgagaaatgggaaacttactacaaggatttaggtgtaatcccagttgaagaatgggaccagtttaagaagacttgccagtcgcaattacctttaacttttagaatcactggttctcgtaaacattctaaagaagtactacaactgttccaagaacaccatctacccaatttgaccaacgttacttgggaaaatgaagtggttaagccaccaatggctttgccatggtacccggaacatcttggctggcaattagatgtttctaagagtgttatcagaaaaaatgaacagtttgctcgtatgcaaagattccttgttgttgaaaacgctgttggtaacatttccagacaagaagctgtctccatgattccacctattgtgttggatgttaagcctcaccattatgttttggatatgtgtgctgcccctggttctaagactgcacagttgattgaagctttacatgccgaatctgatgaaccttctgggtttgtcatagctaacgatgcagactataagagatctcatatgttggtgcaccaattgaaacgtttgaattctgctaacttgatggtcgttaaccatgatgctcaattcttcccacgtatcaaagtggattccaccgaaggttctaaaggtcctcagttcttgaaattcgacagagttttatgtgacgttccatgttctggtgacggtactatgagaaagaacgtcaacgtttggaaggattggaacactggatctggtctaggtttacacattgtgcaattgaatatcttggaaagaggtctaaatttgttgaaagaaggtggtaaacttgtatactccacttgttctttgaatccaattgaaaacgaagcagttattgctgccgctttgagaaggtggggtgataaggtaagattggtcaactgtgatgatcaattgccaggtttagtcagatctaagggtatcactgaatggaaggtatacgacaaacaattccaagttagagaaaaaggacatgaaaactgtttggattcatggttcccaccaactgcagaagaggttgaaaaattccatttggaaaactgtatgagagtgtaccaacatcaacagaatacaggtgggttctttatcaccgttttcgagaagatcgatacatcaactgctgaaactccggtaccagcttctgaaactgctgctgctgtagaagaacaagcccaagaacctgaactaaaaaaggctaaaatcgatacatcctctactgcctctcacattcaaaagaaggaaaaactacctcgtgatgccaatgaagaaccatttgtgttcgtggatccaaaccatccagcattagccaaatgttgggagttctacggtattgatgacaaatttgataagtccacttgtttggttcgtaacgctactggtgaaccaactagaactatctaccacgtcgctactccattgaaacaattgattgtaaacaatgaagatagactaaagattgtttactccggtgtaaaactgtttgtttcccaaaggtcagacattgattgtgcttggagaattcaatccgaatccttaccaatcatgaaacaacatatgaactctgccagaatcgtcccaggtaacatggaaattctaaagaagttgttaactgaagctttcccaagatacgaagacttaacagcggacaacgtcgatccagaattcatttccaagactcaaaaactgagtgcaggatgcactttcattaaagtcgatagaaatgatccatccaaggaagatttgtttttaccagtttggaacggatcaaaatgtatcaacttgatggtttgtaaagaagatgttcacgaattgttgtacagaattttcggcatcgaaacaaccagcaaacaaaatccaaaggctgatcatatggccaagaaggcccaagaagcagctgacgcatcagctaactcttcgaaggaagagacttctgagaaagaagaagtacctgctgtaactgtcactgaaacatccacggctgaataagtttcttcactccacattatcagttatagacttctacatgaaattataaaagcggtattcctttgaaggttgaagtaatcattatttaagtctattagttacaaatttgtatattatgctaatataagcgatgtagtactgcatctataatggaaaaaatgggaacggtatattgttgttctgagcttatagaattgttttcttccgttggaaatgttgaatcttgatttcacattgttcccatagtataaacagcgaaagatctttgtagttggcgacgtacactaatcttttgtgcacccacaaaactgtccactgttactttaattgctctgtctaaatcccatgaggaaacgaattctgataatctcattttcgcgaaggcttcagcaattcttaagatagattccaaatgacgaacggtgatcgggaatgaaccagtagtgacactctctcgtctcaaatcagcataaaccctactcactttgtccatatccatttgatgtaacttagggtaaactttagttcttgcgtaatgaatatacttcattagcatatgctgagatatgggcgaaatttcttcttctcttttacgaaggttctgcaagcgtctttgtttggcagataacggagtttcttcatcaccctccccattaggattttccgttggaacgttaccatcatcaaaatcatccagatccttgtctggatgagacctgatatgtgaatcaacgacgaaagatgctagccgattatcactttcttcatcaaccaaatctcttaccacgcagaggatatcgaatcttgacaaaattggttcagtcaaattgacattttgtgataacggaagagtagagttgtaacgaccaccgatcgggttggcggcagctaaaatagagcatctggcttgtaacgtggtaacgatacctgccttagagatggatatactttgctgttccattgcttcgtgaatagaagtacgatcctgatcgttcatcttatcgaattcatcaatcaaacaaacacccttatccgcaagcactaacgcaccaccttcaagagtccactctttagttatttggtccttcctgacagaagctgtcaaaccgactgcagaagcaccttgacctgtagcgaagacagctctgttggcagttttttccacgtatttcaaaatttgggacttggcagtacctggatcaccgagaagtagaatgtttatgtcaccacggatggaatgcttaccgttaatgtttttaggaacacctccgaataaagaacatgcaattgctgtcttgatatccctgtgcccataaatagatggagccattgatgaaatgattttatcgatgattcctctgtcacgagacatctttctgaattcacgctcttcgtcttctgtccaactgaaggcatccagcccttcgtgttcatcaccatcatgcaatccgccttctcttctcttcactgaattggcttccagtactgttgcgaaaacggggaacccgttctttgcattcaaattaccgtcatatgtgttcttatagattcctgtcacttcgacttcttcaccaggttttgcgatatcaaccaagtcccacaacaaaatgacttctctgtgacgtggtaatctaccggctggaacagaccctggtgattcttggatggtgattctttggtaattacggtacagagttttttccatattaattctgaagggacccttagatctacaatttgtgcagaacgagattttaatttcttcatttgaatcctgatagtaaggcccaagtgtggcaccacatttcaaacagttgaatttaacgtatttaagttgtgggaagacaccagttcttcttgtcacgacaccactaactctaactaaagaattcaaatgagtttcacgtaaagcacgtaagttcaatatactagggaaatccgagattcttacgtgaatttccgagtgaatacgagtataatcgggatagtgtagttgtgtagcttccatagccactgtatcaaatattttcaacatttcttcgggagatttggctaaaaatagggctagaatggccttggattctaccaaatgtctataattaacttccaaggattcagagttcatttcaccgagagttctgatacgagcaccgtaaacggatttacctgactcatcagtatattcaagcaaaaacgatttcaactctctggcaatagtacgtgatacattcggttgagtgatccattcagaataacttgatgccttcacatctgccaaagattccaacgagagctcatctgccaacggatctatatccatatctgataacaaatcatcatctgcttcttcgtattgacgtcttctacgtctcctctgtactggaagacccatagcatccaaattatgcgcaccagctccttcgccatcatcatcatcaaggtatgctgtgttcctatgcaccaaacgatctctctcgttcaattgtgcatcgattcttctacgctcagcgagcgacaactcttgctgctcctggtcgtcgactcctcttctttcatacgtatcatgttctgtgtttgaagcgtaatcacggtacatatcatcacccatcaaatcgacttcattcattctttcttccacatcttcaagatcctcttgaacattgacagcttcatctccatcgttatctggattctcaaaatctatctcatctggagatccaagcgggtcttcaaactgtggagaactagggatgttagcgccaccttcacggggttgtgtagacaaagaatcatcctcatcctcatcatcatcagctcttcttcttctcctccttccgttatttatttcatcattatcagacatcttgaaacactttcaaaaacagcaattaataatcttcaattatcgcactaccaaatccgatcacacaattgtcttcctgatgcttcgatgacctacttgttacactttgtttcagaccattgggatctaaagctatcttaagatcttaacgttttttccggcttttttcttcagttgaatgtacgaaaatgatctttaattgaaacaataacatttcctaaaatggtgttttgcaacgatctgaccattgtagagcgttggggctaataatacagcaatggcaatattccaataacaccaatcggtagttctcacctcttttagctttgcaatctacatttgattagtataatttctttattatgatgcgtggatcacgtgataatcacatgggatcatacgcttaaaaaccgtacttatagctccaatcacacgatgaagcaacacaattgcaggtaaagtatggatgttgaagctctggaatgatgtgatgcattttgtgccccatattagatcgatttccatccggtaaccgtccaaatgtgtcgatattgacgtaaaatcatacggaatattgattcatcgacatggaaaatctcttactatcaatgaaatatccccaaatttaaacataaggaacacgtcaagttaaaggcaaaaagggtaccttcattcacgcatttcttactacaaggtgagttctggcacttaaagatagtcttgttggtgttagggaatgagcgagattagcgttaaagaatatgtgaagcgacaggaggaactggaagatgaagcaaataaactgatgccatatgatccaagccattgcacttattccatgggcccaattcgacagccaatattcgcatgtcgtacttgcaacagtataggagtgtgctattcatgctctattcagtgtcacagtacctgtgacttggtggaacttttcgataagaggaatttcagttgcgattgcggtacagaaaggcagtttgaacacggtgagaagttcacaccttgtaatataagaaagaatactacaccagatataccagacatgagtaacaggtatggccagaatttcaaagggttattttgctcttgccatagagagtatgacccgaatacaacgacaacgatgttacaatgcgtccttggcttggagtgcaatgaggactggtttcatgatcactgcattctagggatagaagaaaacccagacccggttacagaagacagaaagctaccaggattccctgaactgtcaagtttcgaaggatttatctcatgggtttgtattgacaagtacagctcgatatttgaaaagcttttatcacacgaagcgtgtgataaaatcatagcacataaagtgtacaggagagatctggtatcggatcagaactccgagggaatgacattggaaagtaccaagaaaagagggctagaagaaatggaaaactcttcgggttcatattcattattcttgaaagaaggatatagggaagaatttaaacgattaagggattcacttccagaaggtgactccttgaaaagctttttcatgcacacagcaccattcctcacttgtgaagagaaagtttatgaacccccggaggaacaagagcaaggatctcttgtagaaatgggagaaacggccctagctcaaaacttgtctcatcagcaaactctagccagtctagtcgctttccagcaaataaaatcaaaactaacagatttcctacgaccatttgcggaaaacgataaggtcgttagtgaatctgatatcaagcagttttttgatactcagaaaaaatgaactcttgttacgacatttaatcatcataaactttaaatgtggatatgttatatacattgctacatttagaagaatttattgtcaataagagggatatctcgagcttctactctaaacttttcatttacacatgtatgtattcaaaaaggtgttagttttatataacatatgagataacttgcatatccgaatagacttcattttagtagatataagagtttttcaaagtgaattgtctatggtgccacaatgatggccttcaattcagtgtaatcatcgataccatacttagaaccttctttacctaaacctgaattcttaacaccaccgaaaggtactgcaggttcactgatttctccagtgttgacaccaaccataccaacatttagtttctctgcggcatcaaaaatggtgctaatattttgactgtagaagtagcctgctaaaccgacatccgtgtcattagcacgtttgatgacttcatccacatccttaaacttaattaatggagcaacaggtccaaagatttcttcataaaatatatccatggactcggttacattaccaagtactgttggttggtagaataatggacctaaagaactagctcttgagccacctatcaagacgtctgctcccttcgtttttgcatcctgaactaaagatgcgactttgtcaatggatttgtcatggatcaatggaccgtgagtgacaccgtcttggaacccatcgcctaatttaaaggttttgtcgatcttatcaaccaacctcttactgaattcatcgtaaagatcttcatgcacaaagattctgtttgcacagatacaagtttgtccggattgtctgaatttacatccgattattccatctaaggcacggtctaagtcagcgtccttgaagacgatatatggtgcattaccccccaattccatagagaatttcttgatattctttcccttgcttgattgtcccattaacaattgaccgattttagttgagccagtgaaagtgatcttcttgaccaattcatgttcgcaaacgtattcacctatttcacttgtgtgattagttggtaagatattgcatacacctgcaggaagaccggctttctctgcgatcacccctaacgccaatgcactcaacggagtttcatgagcaggtttgatgacacatgtattaccagtagcaatgactggtgctaactttctagcaatcattgcgctagggaaattccacggagttagaataccaataacacccaatggttgtcttattgtaaagatcttttggtcactggatacagcacttggaataatatctccataaattcttggagcctcttcagcaaaccatttgaagaacattgcagagtacacaatctcacctagtgagtccttgtacggtttaccgttctccaaagttaagattttggctagatcctgcttgttctctagcatcaagttgtatatattgtccaagatctgcgcgcgctctctgacgttggtctgtctgaacgtcccgaatgcatcatgggcaatttcgatagccttgttaaaatctgaaacaccgcagttcgtaacctcacggatcgtatcaccggtggagggattggttacagcaaacttgtcgtcagtttctgtccatttaccgttgataaaggccttggtttgtatcaaataatcgttctcaattttagaagacatctttcttaataggtttagcgttcttagggtattcgagttgcggaacatcttaactcttggaaataacacactcagcgacttgacaatttgttagccattaggatcgccgtttatatacaaagttctgctcttattgcttcatgcttgctcttaatagcaaaaagtgcgtcatattaaatgttatataatatccattatgtagtgtagagatgatacactatttaaggttggaaagaggagacggagccgaagttaacatcagcatgcatcaaattctgataattcttatttaatcttgctatgctcggtctatatattgctgtataatcactacattttgctatgccctttgcttaaggcacctaaatattaccaaatcctctttgataccatcttgtatctttcaacggactctagcgatttaggatgcttcagatctctcttggttctttgctcgttgaggctaggtgggatgcttgccttcttttcaaaagcagcgagttttggcgatcctggtggtgtaattgttggtgaataagttcttgtctggctagagtgtgtcattttgcgggcatcctcatccatcattcctcttccagcagagagatggccattgatatacaaaggatctgggtgcaagctggcttgtttgttttggatatgtaacgtccatctcaacagtattgcttgaagtgttagctttgtgagtagagcccataggaatccaaatattatcagaacagtggaccagatgatattattcttgatcgtttgcctgatggcaggccataccagtactaggaaggctactattagtggcgggaacggcaaacctaacctcttttggaattggatactgttggataggttgtccttggaaagaatttgcaaatacctttcatagatatgcgctctgattctgttgaatttgataatatatgcgtgcttgatccaatccactatcaattcacttccaattactgtgacaatcggccctataaatataccaactatcaaggactgtgtagaatgaacattccatgagtgtggtaaaacatcgcgcaagctctttcttgctacgataaagtttctcactgcaatgaccgttagaaatacgatcaactggaatctttccacgacgtcagccatagtcaattggaacaatccttctttatcaattctcttgaaaactgcagattttaactctgaaaactgcattgacaacagtagcgtccataaggagttagaatacgagtttaccgcaacgttcatggcaagaatctggtagatgtatatcaacgcgtggaaacttaaacataaacaacatgcaatatatagcattaccatctctgtcttatgtttggcactcttcttgagcatgataattgaatatagatcaaggccaacacttgataagagcttttctgtcatctcaagaacctgaaatatcatgtatagtttaatagcattttggcccttaattttatgatatattcttgaggtgtcaaggacattcaatatcgaacagggtccaagaatcatcgcagtagtaagaagctcttgtcgtattcttttaggaccatctcgtttcaccactaatacatggaataccctaagtggtataatggtaaagtaatacaagaagcagttcaaacaagtcaatatcgcaaagacaaagaattgctcgacttggaatggtaccctcagtatgttcgcaatctgctccagatcatattcaacagacttctcactctgatcacatggttcctcttcgaataccttggctgtttggggaagaatctcctggtatataaagttctttatcgatgatgacaccgtattcacgtcttgttcaaccgatacccttctcccagcaccagaactgctttccttagacctcgcctttcgccttttgaggtgggcttcagaatcctgtgaactcatttgttgaggcacaactgaccggttagtgctaaggaccttacttcgtcatggatatttctttcttctgttgttgttgtctgctcgaattcgatctacattgaattaaaataaagtccttgcttaaatcacatcgaagggttgatagtgccaaagtaaagaaggtaaacttaagaaaagcacatgaataagggacctcatacagctgcttgaccaactacgaccgtgaaataatttaccaaaataattagactatagcaatggctaccattgaagaaatcaaagaggttgtattaaaaccctatacaaaccatcgacaattgaccataagggaagtggaaactataagtatcaatttaatagacttattgattacaaaagacgtgaaagatgcaaggacgatgaaatacatttcaaggttccttaccaaacaggattatgcggatctagtccaagaaaggaacttggtgaagcgttgtggatatccactctgtagcaaaagccaggcgagagtacgtgatcccttcgcagatgtacagatgaccaatttcttaagacaaaataacccatatgcataccttacagaatactgtactaaggctcattttagatgttcacagttttaccagtttcagctctcagacgaggctttgtttgctagggtcggtgtacatcttgacgattatgagccacctagtgagatacaattgctcgaagaagtactagctagagagtctgatgttaagcagatgattcgtggtatgactgatttgaaactcgcggacgatgatagtagagaggaaatggaaagggatatcagtgacatgttagctgatattaagatcgtagagatcaacgagccaaatatcattggagatttaggacgagatagatgaaatgacagaatgatgacaagtacaaacatatttgaggtagagcattttgactctataactcaaaatatatggacaatcctgcattatatagtcatacataaaatagttttatttacgatttaactttcactaattgatctggtctaaggaacctccatttaacaagcaaagcacctaaatttttctcttcggtaaatgggtttgtcgttggtaactctgctttcaagcccaagaatcgttcaagcctttttttataaagtctttggttcagttgtttataatattcatattgttttccgtcaattaagtgatctctactttcggtgaatttacgctgtgtattagcatttatccggttgagaatgtccatatcttcgaggattggttttatccagtcgatgaacactgcagggatgtcattggacttaccactctttatctgtgtcacgacgtcattgaattttcgtgaacatggttgtttgtgaatcaatgtatattcccattgtgcttcttgaaatgcatagaaaagtttggattcacactccctaaatctatcgagattatcttgagctctaagccgtgccttaattatgattcctgtcaatttcttagactggcgtgccttcctattgaatggagatcgtatgaaccaaattcgggattggccagcgttggtgtagttaatagaaactttaggggggcccttggcaatgcggtactcaatcctgtacaaaattttacagtatctctcgtggattgcaagaggtctgagtagctcgtcgatatgtttacgaggtatcgttttagtcggaccatatattttataatatctaagaaggtagcggtataaatcaccatcaccaggaataggtgctaatcgcttctttttttcccttcgactctcatcccccatattttcagttaccaccacaccagaaattggtttgttcgcttgctgcaacggttctggagcaggctcgatctgctctgtgtatttgttctttagagcaactagcttgattatatcatcgccgacaatatacttattcagatgagagagatcctccaataatccacgtacgtaccagccagctttatgatttctgttacgtcgtactgcttgtctcaatgtgttccaaagctcaatctggagattatcagtgggtacgttggccctaatgtttcgtaatgaatatctgtaccattccaatacgtgtttcctatgacttcctatctctccaaatggtcgtaccattgatataattctgctttgtagagcttcatcaatttgataagattgagtaggatgtaccttgaattcttcctgttttcaactactcatctattcatgtcatcgcatctcatctcatcttgacaatagtcataaactttgaaaacatacagatcagcgtgctatacatgcttcgtatggtgccgtgtgagacgtcattttacagcaaagtggtttcgtggtctagtcggttatggcatctgcttaacacgcagaacgtccccagttcgatcctgggcgaaatcattttctttttaattttttttttttgcctcctgtgtactttaagcaacaaatcagcaacaaattctactaccaagctacacacaatattgtttgatttgtaaacattgtggttgccaagtttcggttgaatgactagtagagcattatctctatcctcgaactccttttctcattttatcacttctaaagtctctttatgttccataatgatgcaaaaccataacaatctccgctatattcaaagtaacagtgaggaagaaaacgacaattatctaaatcagttgtggtacgtgattattcatgacactcactataaatcatccgagctacgcgattactgtttctagtatttctccagccctgttgcgtgctgatcacttcagagaacagtcaaactcccaaaatttgacctaaatggcttcgtggtctagaggtatgatttccgcttagggtgcgggaggtcccgggttcgattcccggcggagcccctgtgtgttaaacactttttatttttttttaatttaatcaattaattggtttttgggcttcgcgaagcccaaaatcaaaaacattcggaacctcccgcgtgcgcacgcgcacgcgcttgctgttgaccaatcgcactttaaagtgcgattgtcaacacacgcatttcgtgcgaaaagaccaaccaacataccacgcgatccatgcttcacaacttttaccaatgtcccactgacgaaaggaaaaaaaggggaaacccagcgaacccatgtccctatgtctcgcttcatgtcccttccccgattaattcttatcaaggagccgacaaggatggctgaaatgtctaaattttgaaatatgaatactaatttaaaaaaaaaagaagctaaagcttgtaagcaaagcgagaatctttcactggattacagagatatgatggggaaacatactccgtgcgggctgcaaagagtgaatagggtaaaaaaaaagaactcaattcaacggagttgagttcgaactttaaaaatttgaccattagcccctgtgatccaatagcatgtagcgtgtaaactccgtaggataatggtctaatggttttcgacccggtcattccagtgtggatcttttacaaaacagcagttgtttccagggatgttgagttacgttgtatctttcgataatatccctataattctcggtatgtatttcattttttttttgatcattcatttttttccttcattgtttacgttattttgactgaggaaaacaactggctcaaaaatgagtgacaagatcattcaaattcgttagtagtggtgataggtttcagtttattgttttgtaaaaaagagacttgtttcaattgaatataaaagggggcctgtaatttctttaaaaaaagttctgctatgacggtagtttggggggagcattggttttgatatcaatttctgttggttttaggctcaattaagtaacttttttttgagtgggaagaacctgtatttagatatcacacatagatcccacgcaactctaaaaaaaaaaaaaatgtctactactatgttatctactagaaacgcgctagcgcgcggtttgctacgcaccagcggcggtgccgctggtgcttcaagaaacaacttgttgttgtctcttgttgcatctcgttattacagtaacggtgaaaaaacgttgaagcaaaggtttgctgaaattttcccagaaaaggccgaagaaattaagcgcctaaagaaggaacacggtaaaaccgtaattggtgaagtgttgttggaacaagcttacggtggtatgcgtggtatcaagggtcttgtttgggaaggttccgttttggacccagaagaaggtattagattcagaggtcgtaccattccagatatccaaaaggaattgccaaaggcagccgatggtgaagaaccattgccagaagctatcttttggttgcttttgaccggtgaagttccaactgaaactcaagttaaggctttgtcagcagatttggcttctagatctgagttgccagctcatgttgagtctctattggataacttaccaaaggatttgcatccaatggctcaattctcgatggcagttactgcattggaatcagaatccaaatttgccaaggcttacgctcaaggtgtttctaagaaggattactggaactatacttttgaagattctttggatctattgggtaagttgccagttatcgcctccaagatttaccgtaacgttttcaaagacggtaagatcacttccattgatcaaaacgccgattacggtaagaacttggcccatctattgggttaccaaaacaaagagtttgtcgacttgatgagattgtacttgaccatccattctgaccatgaaggtggtaacgtttcagctcacactacccatttggttggttctgcattgtcctctccatatttatccttgtccgctggtttgaacgggttggctggtccattgcacggacgtgcaaaccaagaagtcttggaatggttgttcaagttgagagaggaagttaagggagattactctccagctaccatcgagaaatacttgtgggatactttaaactctggtcgtgttgttccaggttatggtcacgccgtcttgagaaagactgatccacgttacactgctcaacgtgaattcgctttgaaacatttcccagattacgaattgttcaaattggtttctaccatctacgaagtcgctccaaaagtcttgaccaagcacggtaagaccaagaacccatggccaaatgtggactcccactctggtgtcctattgcaatactacggtttgactgaagcttcattctacacagttctattcggtgttgctagagctttcggtgtcttgcctcaattgatcatcgacagagccgttggtcaaccaatcgaaagaccaaagtccttctccaccgaaaagtacatcgaactagttcaatccatcaacgctaagaaatagattgtccgcccgacttaatgagattatgatttcatcttcaacagaataaacagaaacaaaaaaacccacatataaaaaacattcacaacttacacactcacaatcaacctcaccctcacaatcacaatcacaatcatacacacacacacacacacacacacacacacacactcacacacacacacactcacctttatatttctgatcatttttctatttttacataccaaattttaacttaaacttatattaaatgcgtatctcactcaattcctgtctctctctacttagtaagcgttactagtaaatcagtaagtattatacagtttatagggactcatgatatgacaaattgtgacccaagcaagaaaaggatcccccgccatatgtgattacatacaccattggtggtcttgaacttagccttacaaattgtttgataatgatactctacaaagatgacaaaaagaagactaataaaatgaataagtttgttttttttccttttgggtaaagaactgaggaaatgcacagaaacagccgaacctttttctttgttgtctttttttttttttaacggccattcgagccattgaaattttatgtttagaattaaaggatgttttttaagcaaaaggataaataaaggaacattgacccttcgatagcactagctttcttgagatttgtttaacagtagccttttcttctctgtaccgtgatatttcattgtacttattagtttagtatactaagtcaaggttttttttatttagcaaggcattacagttaataaaaactggagaataaggtaataggggaaaatggttaaagttgctattattacatattcgttatatggtcatattgattctttggctgttaaagttaaggaaggtgtggaaaaggctggtggccaagccgatatctttagagtggaagagactttatctgaggaattgttaactacacttgccgcaccagaaaagccagattatccagtggccacgttgcaaactttagaagaatatgacgcattcttgttcggtattccaactagatacggaaacgttcctcaacaatggtccactttctgggatactacaggtgggttgtggcaaaagggctctttgaatggtaaaccagccggtatctttgtttctactgcttcgccaggtggtggacaagagacaacgatcagaaattcattgtcttatttggtccaccacggtatgattttcgttccattgggttacaagaatgcctttgccgagttgtccaatactgacgaagttcatggtggttctgcttggggtgcaggtgtcattgccgcaggcgatggttctagaactgcttctgacttggaattaaaggttgctgaaattcagggtcaaactttctatgaagtcgctaagaaggtcgccagaaagtcttcttctggtaccgctactgctgacgcaaagaagaaaactgctgcaaccgctgaaagaaagtctgagaagcctgccgcagctgaaaagaagaagagcgactcttgttgtactattatgtaaaaacacttaatatcccttgccataaaataaaagaacacaaactaatcaataggtaataatataatataacgactatttttttggtcttttataatctatatatgccgaaaggtatgtatctcttttgtcaatcattcatcgaaggaaaatccgaatgaaaatccctccgaagattcttttgttagctgattccatgcctctgattcacgaacattagcattagattgttcctttgacagctgttctaattcaattgatttcattttcactaaaaactcgtctagtttgtcaccgtatttggatttcgatattaattcaacgaaaaattcgtaaatcggtggatgtatgtctttagtgtcaagtacaccgcagtcttcgttgtcaatcttgtatttatcgctgttctgtatgaagctgtgcaaagcatcaagcctctcgttttgtgattgatcgtctctctcctgtgtatccaagaaaactctcacagactctacgaaatctttcaagtggaaccccgagatttgcgcaggcttgttcttgaagaaattcatcacttttggaacgattggttcaggtacaaaattctctgttaatgcaactgaatctgttaaatttatcaccgaatgccaccatcctgagggcacgtatatacattctccagggaaagtgacacagatctgacaccgtccctcttgtgccaacttcactgcatcgttataatatcccgagataatccactctgctataccgacaggcgatgtaacttcttcttcttctttatctgtcatcacaccgggtgggttttctccaggtggtaacattacccatagtttcatgccgctcaagcctgtattccatgcagaagtgtgattcggatccttatggaaagtggatccgcttcttgctggaccggcaattagccatctgtgatcaggtcgacatttgattcctttttcttggaacaatttgaagaaatcgttatggtagatggaaggtggagcatactctttactcatcagctttaaggcagtgctattacaatcgaaaaggtacaaaggcgactcatctctattttctctgaaatagtaggaatataatgagaggtcccatttcactgcttcttggcggaatatttcatggggatatctctcgactaaatcgtccaacgtccatcttggccatcttggtttcccctccgaggtaataccatctttgttttgaagaatgaaaggcttattgataaactcttcatggaaagttgccacatcaaattctgtctcttgcattctaggtactccaaactctgtgttcagacatgtacctaactcatacgaactcgtttcgaattcaatcacttttttgaaaagctctgtataatcgatctgagaacattgatatggtctatataaggtgtcagagaacagaatattatgacactgtatcaatgcttcttggtctactttcaagatggtctttctccacgagcccctccaccttgaacatccaaacggcgaaatacgctcttgctctggactttccgattccaacttcaagtactccttggtataaatctttctccatagttcctcatcgtaggtgtacgcgtaaaggatcctagaactacatccgaggttctgcaagtcatttggatcatcgatatatgcgagtatttcgattataagatcttctggtagcactgacagagagcctaacagctttttcctaagctttctagtttcctgaggatctgcaccctctaataaagaattcccgctaggttttacccctaacggatgcgttgggatgctggtaaatacaggaatcctgtaatttggcacctttttcactttcttgaactgtcgtgtcgttgtcatactgtatggaaaattgtcagccttattgtcaatttaaagtgaaacaaaacaaaacaaccaatatcagaccaaactgttaaactgatgccagttttcaggtcctgcttaatcctgtatcgtgtattcgcacctcatctcatctcatcgctacttcaaatcttttcactcatgatttttttcttttcaatctgatcttttctcgactgattttcacgcctttaggcctggcatcaagcctgctctaggaaaatttttgtatgtgatttgattctatgtagagttgattgtgatgagataatgaatctaactattactacaggaggtgaatgctgacactgaaataacctgctaaaatctgggacgtgtattcgacatatatatacaaggtgatggggggattgaacttgataaaaggttgtttttttttagtcatttccgccgatgtgttattttgtactggattcaatgagaagagggtttaatgtgatccttctttcttctcagatctctccactggcagagttttcatacgtctctccaaataagcatccttgtccttcagtttctttgtgtattcagtttcttttctaccaggatacaagatacgcttgtccaattcagacaactcttgttcttgaataggctccacttgttcaacgttagtgtgagccttccagatgtgacggatttcacccacacaatgcatacatagcgtatgtgccttcttgtaatgcccacatgaagggcatttgttcaaatggttgatcattttcagctgtttgtctccaggcgcatataacttttgtctcttcttctgatgcgacactttcttcttgggcacagctagaaggatcccgttattcgtaaagtaatccgcttgaggtgaagacttttcacgttggtttctttcaagcaattccagcagtttctgtggcaatgcagtaccagctgctggagtgctccaacgaggcaatattgatgtcgctgtttccagcaacactctgctaaaagattccgttacagctccaaaagacatcctctaattattttcgctgctggtatgatactatgatgaagaggagaaaggataagttcaatcgatagggacagatactagtttctctaggtcgctcgtctaactctgtttgaacttcgtcaattcaaattggtattgacgaattggattataagaaagaattttcaacattaccctgatttggtgatgatctgtgtccctttttcgatttcgatgaaaaagacgaaaaatcacaaaaactaaaaatggaactcgaaacgaaataagtgtgtcaacaaaatataagtaaggaatcagatcttgtattctttagaataagtaagattgtgattacttttttttgacgtttctgtggttaattgctactcattgtttgaatttttgttattgcggttaattgtttttataacttagaggtttttcattattttaacttccaaacactaaaacacgtaaagctttgatcatttggatttgacttatatacatctctactacgcgaaaggaattattaaaggtaaaatacacgcataaacaaaaacaatggcatctagtactgctgcagctggtatgacttcttcttctgatgggttggctttggtaaatccatcttcttatgttgggtttgattcgattacttcacagattgaacatcgtttgttgaagagaggatttcaattcaacgttatggtcgttggacattctggtctgggtaagagtactttgatcaacactttgtttgcatctcacttggttgattcttctactggtaaggacatcactcaggaaccaattagtaagaccaccgagatcaaggtttcaacacattctttattggaagaccgtgtacgtttgaacgtgaacgtgattgacactccaggttttggtgaccagataaataacgacaaagtttgggaacctattgtcaagtacatcaaggagcaacactctcaatatttacgtaaagagttgactgctcaacgtgaaagacacattgtagacactcgagtacatgcagtgttatatttcatccaacctaacggtaagggtctaacagaacttgacgttgctgctttgaagagattgacagaaatcgctaatgttatcccggtgatcgctaaagctgatactttgacgttgaatgagagagctaacttcagaaacatcttacaagaagaatttaaaaagtacaatttcagaatctatccatatgatttagacgatctgaccgatgaagaagtggaactgaataaaagtataagatctattattccatttgccgttgtaggatctgaaaaggagattacagtgaacggtgaactagtaagaggaagaaaaactcgttggggtgccatcaatgtcgaagacatcaaccaatgtgagttcgtatatttaagagaatttttgatcaggacacacttgcaagatttgattgagactacagctttgatccactacgaaagtttcagatccaagcaattgattgctttgaaggagaacgccaacgctagaacttctgcacacatgtctcagacatcaacaacaatgctgcgttaataggtggaaaaaagagccgggaagacttctagaagaaacggcgtctttatttcaaaaaaatgtagcgttttaccggtacgcaagagctgtgccaattattttttttgtgttcttcactggtttgaatcctgccctagtaaaatgtcgcttcatttccatatatcttattgataattggtaatgtctctctatttctacttgtcaaacgtctcttaatctcttttttatatatcacattctctttttaggatttataaaccccattagttaactataatactacatcacgtataaccaactggtaattaaagtctaagaaattggacggtgctgttgtcctcccatttttgtactgagcagatgtatgcgaataaattagtgtagacaagctccagagtaatctacaatgtatcatcactgcatattagtgtctacatgaagacattcagtgtttaaattttattccagatactaaaatgttctattttgtcatatcctctggaatcttttttttattgtgctcttctacgacttctgagtagaatggagtctacagacatttggcaggagtttatggaagtccttaatgtctttattctgcttagagcgtttcatataaaattcactatcaatgtattttctgcgcatggaaaaacgaataataaagcatcggacaccgtccaaaactcgatatacgctttcaatatttgtatgattggtttgggcatgcaaagatatgggcctttcacaaagtgatattttggtcatctactagttttgacaacttgggaaaatgttaaaactaggatgctgattcagcctttccagtgcacatcgatgttctctgaaaataataaatagagttagcaactatccttggggaaagaactccagtaaaatattctgcaggatgcattcatgactcttgtaatccatactaggtttaacgaaatatttgctgttgatcacattctagtagtgagtgaattacaaatttcttgtgcgctgcaatattcatataacgagtaaaatgtcttgaaggcaaagcaagttattacactgcactaaagcatagatcaaacagtccacagatccgataacgaattcctttaacgctctatcatttctagccgtcaattttcgataagtatcaacgccctaggaaaaaaaccaacgctgccaatgggacattccatggtggatttttggcttatggttgttgcggaactgtttacggctacactccaacacattcgcacactctcagtatgtgttcgttacttgatatcttcgcaacattcttacagtttacagtttacagttactgtccgcaatcacttaacttatacttctatgccgatcaaggtagcaccattttcaatgatacatcgaagaaaacctcacgctagcagatgattcggaaattagttgatcatgaatatccagttctatgttagttagggtttttcgcactgacctagctacatatgtcgataatacttctcatgaacgacaaattaatggaacataatactacaaatggtcctaaatcaataataaataaagaataattttaataaaataattataaaataaaaaaaatataaaagtgtgaatgaaacagataaggaataattaaacaacaccaaagtcacagatattagtagtcgtcaggtactcaatccaatgtgttcctcttgtacctttctactgctttagaattgttctttagctaacaataaagtgtactttatgccttattatttattatgcacgtgacaataaataatacatttttataaacttataatttttatatttaatttttaaaataactttataattatcatattttaattatatatattaatttttgttaactctaggttatttataaaatagaatatttttgattactactctaaaatttaaatattaaagatgttttattgttccgaaaataaaaatattaatgaaatattttggaaatttaataatatttttctgcttgattatattgatgtttttgataaaggcgtttctatgaatctggcgtttataaggtacatattgttttctatgatagaaagagcatcccttccacatctgaggttaaattctgaccatttggataatccaacatcagtaaattagcttcacggataaacgttaatgctttgcatattcaatactgtttttttttttctgtatacaaaatattatcttcatttctatttacattttgaacttaataaaataaaacttaggatcctatctaggactatagaatgtctccgataatacctgatgctttttgataagtttccaaaaggttgacgcatttttcgcggtcctgtgctaaagtctgatcttccatcaagagttcatcgaagagtgactctttgtaaagctttgtgactagtctattttggacagattcttttgaatagtttactagcaagcacattacagcctttgggacctgatcttcgatcatctctctaacaatggaaaagtatgagacgatcaatcttctaattaattcacattccaactcttcacgttcggtaaattcggtagcagcttcagatttggtatgggcatctgcgctcttgtctttaaaatcttgaatttgcaaattttcgatgtcataagaattatcagagccgttataatcaattctcgaagaaagctttgtattggaactcttttgttctttgccgaagaaataattcaagaaggaatcctttgattgcttcatatcattttcttcttcagagtcgtgctcgctggttgctgtggaatcagaatcaagcttcaaatcttgttctgtctcatctactgaatcggatttcttcatttcacgttcagcttgttgttgctctaacagtagctgcttctcatattccctctgtttctgaagtctttccgtttgctttttgttctttctagcttcaacaatctcggccatggcctctgtagcacttgggaaatttggatgatttgtgttaatgtacgctttatgaatatcaatcaaactttcgacgtaagaacgagttggtcccaatctttccctcaacagttcactgacaacctcgactagcttactttgtagttttggatatcttgctagctcaggagagccacagttgtgacatatcttcatcaattcttcatacaccaattctacgcaacgttgagatggatctagaagtaatctgatttgtggtttaaccaatagatcgaatgctaattctggaacaaacaatgaaggtcttggcccagttgagtttcttatagctgttctgatgtccgtcattgataagttagaagtagggttgatgaagtttagagatttcccgaatagagtgttatagatgtaatagattctggcaccaccacaaagttctttagtgcttatttccgaggaagtaccatcgatggaagaaatgaatttagtagcaaatttattcatcaattgcaaaacaaggccagctctattttctttcgtgataactttatcgtcaccatatgtagccaattcttgttcggtttgtccgatgagggtatttaatctggctttgatatctggcaatttatctctaatgtgattcatcaagacttggttcaataatttagccaagtatctggttccgcatctagttgaaatagttctgtaaacaggatgttttgcaaagaattgttcttctgagttcaaagcttcttcaacacttttgttttgttggatgtcttgctgggatctgttcaccacaccgacaaatcctagcttcaaaggatacaacttccctgacaaaatatccaaagcattagtgccttggtccataagatccaatttagtaataacaccaatagttcttttcccatggggatctatctctctggccaatttcaaagattctgaattaacgagatcgacattagcaggggagatggccaagatgatacagtttggcttggcaacatattccaagatcaaattctcgatttgtctttcaatatccggtggctgttccccaatcggaaccttagtgatacctggtagatccactaaagtcaagttcaaaacatgcggagaatatattttcaagttgattggaattctgcttattcccttctctttccctgcaatcctagcagtttcgttttcaatttcccttctaatttcagaaaagtcgtagaatctacgacctggaatatgtaaaaactcaccccattcattctttatttcaggcttatagtttgaattctttctcaaatgatcttccaaggtcatttccttctccgtgcgggcatctggctcgtcattaacctgttcaagtgacgtagatgaagaattgtcataattataaaccaatggagaattcggatcaatattattcaactgaagaactagaggacgtctggtaacaataccagtaccacgaggtaagaaatctctcccgaccaacgtttccaagatcgaagacttaccagaagattgcgatccaataacagctaaaaccggtagatccaaactgtcaatgcctgcatcgtacataacatcctgtagcttattcaccgtaggaatcaaatcttctagacttgacatcttcagagttacttgtgtactatactccgacctaattaaccgttctaatagactagtttaaggttaacaggatcgcatctaatatctaaccaatcaaagatacactcaaacgcaatatttaaccatttcattggatcaaatttcaaataattattctcaatgcaataggtattttttattatttatttatttatttttatttttatttttatttttatttttatttttatttgatttaatttgttacatttttattctctgtttgatttctgctgaaaattgacttccaatatagagatccgctgtgatgtacgcgcaaattgtcctgaatccattatgtagtatatatatatcagcaccgtcacactacgatttaggtttcctatggacacttagagtgtttattacgttaatagtgtttatttcaggccgttttgtagtagcgatcttgtggtggtttccaataacttttatcatcttcgtggagtaatgcatgtcaaaaatatctcgaatgttcatgtatgcttcttcagcaccttcttcagtgtcatattcttctccagttatgtagttcttcagatttttaaagttcttcttcgaggttggtataattatatcagtccgttctggttcattgcaacggccgatgtattttcctgacactccaatgacagacacagttgatcccagtctgaactcttgccttgcttgcaattctgtccagaatgttaacacattgactttagaaattcgtccatcactgatcagatggtcaaggaatctgcccttggggtcatcagggaataatggtatcctgtataatgcaatgtcttgcggactttcagagaaaatgtctcctacggtccaattttgatatgctgtgtttctcaaatagttggaaattactcttttctcttctcccggtatttgtaaggttgcctttgttttattatcgaaatcttcgacaactatttggtctacaatctttaaccaccatttgagcaatttgtcaccacttaggacgtgtttccttgggtttttagatgagtttgaaaacaaatactgcggctctgccctggtaaaaagacttacctttgtgacaatttccgtcggaaccgggaatgaaacgtataaatcttggtctgggattttaacccttgaagttatccccttcgaatccaacggtctgttggataatatttctaacgctctctgtactgatgtacttctctttataatctttgcaccgctcagtgctttccttatcagcggttttaccgcccgcaaataatgtcctggactaattgccagaatatatgcaattattgacttagttatctgaccaatgtcaagtcttagatcgcaatatccgtttgtatctgctttggagacgaacaagagcctttctacgggaccattattggcagaattcaaactgaaataaacaacaatttcaagagcaaaaacaaccttctcttcaaagcataatgcgacgaaatgttgtgtcttgatggtcttcaccgtttttccattaacgtcttcagcttcgcgttttggaaaagttattggcgaggtttctcgtggaattgactggagattaatgatttcgaactcatgaccgaacggaagtgcatctttaatgtaacattctaaggacatactactatatcataatatctgctgggcttttctatcaattaacaattcaagttcatttctatatttttgcatagctaagagtgtattaatgatccgttgtacttttttataatgcctttctgataatcttaactactgagaaagtttaccaataatggaaagccgaaggcagaatacctctcaggaccgaacgccccttaagattggtcttgatgataaggaaaccgaggtttctcagatttattcttcttatataccaattttattctttaaactaatatacttttgcttacagaagacgggttaagaccgctttatcgtctaatctacaggttttcatactcatcgggatacacaattaaacgttccacaccttcagcagtaaggacaaccattctaatgacaccaccagatgaaccatcccatttgatggcttgtgatagagaatgttttacaaattcgattgtttcttctttagtcatatcttccttatagttcttgtcacagtaaccatatatgaaagcagaaccagaaccagcaattgagtacgactgcttgtgcacagaaccaccaagaggtatactatacacctctcctttgtttttttcatcgtagcccgccactataatacctgctgtgagatgatccttgttctcgtaacataatgtcttgaagatcgatgcagcaaccttggttgtaggttctccatattgtgaggtgtacaattctagatggtactgtacaatatcggcaacagcctgagtgtctgctgctgaacctgacctacaacaccagattttatcatgaacctttgttagtttatctgtgacacggttggcaatatacgcaccagtagttgttctggaatctgcccctaagatcacaccatctttgaaagtcacggccatactgttaacattaattaagtttagttagtattcactgatatcattaaaaccgattgattcgattgtgggaaagaggaatcttaacgttcccttattgatacatacattgaagtacctagactcacttcgccctttttcaagcggttcatatcaacttgaattccatccattttcgattatatttgggaatgatttgatacagttgctcactgatgatactcaatcctgtgaatatcgtcttttaggcggttgcattccttcaatgttgtatctttctgtcaaaggtttgccacccgccaaaagattcagttattccttaatattttggcattatcaacatagccgggtaacagaataatgataataatacaaatacaaactgagaatgtacttagctacataaccggctttgatgcaagtagaaccttacgatgggacgcaagtgtggatcagactagactcattgaatcggtctggatcttcttctagttggagaatcgtcacgttcgggcagagaatcgccttccaagaagtcgagatcaacttttaatttatctggatctggtccttcaaatggctgaggcgatggaaatccgaaaaggcttgtttctggaattttgttgaagctgatgtttcttgtttttcccgctaaccttttattcacactcaatagatatgtagcctgtgcgcctgtagtgtcctttgcagctgtgtttcgctgatcacttaatctcgcctttacagtgctatccagcacatttgttgtcttgattgggcttggtattgctccccgggccctactaaacctattccttattctatccattttatttcttttaactcttgtggagccaggtatcgttaccgcagcattattaggtgatttcatgggagtttgaaatgtcaactcatcattttggggagaatagctagctagttcgttaccagacgaataatttacgattgaaaacgctttctccttccataaactcataatagctcgaaggttagctctgttccatctcactctaaacatggcaactgattcttcattacgcttaagttttaacaccttaacgctccacttgttggtccatttcagtaacaacttaacctgcttttcttcgacatacatggacaacctagagtcctgaatttgaagtgcctcaagctttctaagaatagaatcaaaagcattggaaacagatatgctgtcatgaatttcggcagcctctgtatgcattaattttatgttggaatatttcgttgtccattggagcatagtattcttcagagaactcatatcggagctctgttctgcgatagatgcacattcaactgtgtagaagcgagagcgtttcatccatgctgaaaggaatttttggttaaattgtaaagatcttctatcttcaaacttgtccagcaacatttcaagattaagtagccttttagattccagccgggtcttccaaactttccacaaattttcaacgagcattttactgttacctttagagagttcaatcgacaaacgagttttcatacgagtatcgttaattgaacgcttgataatggtaataaagcgcagcttcatgaaaacttctgctttcctttgtgatgaaagcaatagtttataacgattaatccaaaccataaaatgcctcttactgatatcattatcataacatcgagctgaaagattcccaagatctttcagagaatgctgtttatttttaacaacattgtaatatctcttaaggattaaagaatcaaattcctgagcaagggcgttcagctcaaatttcttacgccaaagtttcaaagctttcgagtatttggcttcttttattgaagagttgaattgggctgctctgcatttcaatgtgatggaatggatgaattttttcttcaaaagtgaggtgtaatgagaattcgctgttgcgtaactttccgattttagtttccattgagaaaagtaaaagcgcacaatctttgtgttctgttgaacgacgtaatcatgactattagttctttcttcgaagcgtttttgccatacatataaaacatatcgttgcagagattcagtgttgcactcttgtaccttcgactcgacattaaccaatttatctgctagtaaaatcatttcaaaaaaccttcgtttgatgaatatattacttttttctatgagtttcagctcgtatgcctctttcttttgatattgcgagatccatttattcaaaaacggacttagatgaaagtttcgttctgagaaagtcgcgagttctcttaggtatatttcatgtgcatacttctttttccattctgtgaagcctttgcaaagtaagtatcgtttcattgtcgttggattataatgaccttcacacatttttagcttccacaacttgaacgatttctgaaggagatgcttttgattgacatttttcgttctgttgaagcattgcgttaacctctcgtgtttcgcttttatgtttgcaaaggtattatccaagaaaaagttatcagcaatctgcgattttgtatctatttgatggatcctatcaagccatgcatcaaaaaaacctgtcttgagtctctggttgtatacttcgtctccgttttttacccattcccggcatttgatatcagatgtttggacccatcgttgaaagaattttttctttacgcacttattccatatctcttcaagctctgaaaggttgtagttcaaagagcatttcaattgccagcttgaaaacactttcttcagtaacagtctttccgtcttgaattgaaagtacgccaatttcatgatgacgttctccggcttcagaagaaatgctgtgatgatgtcttgtaaaatggtggaaaaatcataccctttgcttaattcattttgtaaatttaaaagatacttgtcctgtagtacatcaacgttggattcacctagtagattcacataacgttggaaaatagtcaaaaaatccagagtcaaaccatgtcgcagaaggaacacttggatcatgttatatagtcgctggagaataggaatgtgtatattgccaccatatatattggcgtgtaactcatcgaaattctctgatatactattatagttttctgcagagtaattatcctggacattcgcgttttccatatcatccgctgctatttcaaatattccgttaagtaactcttctggagtgtttcccttagcttgatgctctcgcggcacttcaacaagatttcccgtgagatcctgtttccttaagagttcattgaagtccttatgcaccaatgacccggtggagtgtaaatagtctggtgaaatcaatgcatccgtagaagaccccaccgtatcgctaccttccgtaccgttcattaaaaaacacaaagatagaagggatagggtacgtattcagaatacaatcaattgaaatgcttcaaaagaattagttcataccgcgtaacataacccagtgtcgcagcggtgcattcctgcaaaacaacgcgtggctttttatttacagactaaagttgatcctttggctttcatttttagacctttgaagatgaaattaaaaacatcaaatatagaaaaaaaagaagaagcgcacatttactttaaagatacgtttacattaaagaggcactgtttgaaagaagtggtttacctattttcttgaacactgcattgtgcaagaaagcggtatccgatctacaatgaagtacgcatcattgagctcggtagttttgttactgatcaattttggcattggttgtgcaattgcacaacattgggagaatgtcgagttcactagaaccgtagacttgtcaagatcctacgtccacgaagccttgcaactaacaattagaaatataggggatgaagcagacaatttatatatgcttccattcaccgctgaagttgcagactcattgtcagcagtttcttgtatgttgaaggataaaaatattttcattgattgcgcgttaaccaaccagtttgaagagcttcctaatggtcaaaaattacaatatggagctgtgaaattacctggtttgcttcagcctcaaggagaagttgaattggtcatcagttacagttataacaccaaccgttatcctgttcctgcgcgtattgaaatgatggatgtgcaaacgttggttttagagaccgagagtcttcccctttctcaataccccaccgataagttcacattaaatatcattggaaccaactcaattgaaaaattagatgaagaaaagagcaagaacagcaagagaaaatctggttcgtacagtttcaccaccgacgatgttactgaaccattcacttttgagagatccaaattcttatatgaacataatttgcctttaacaagagcagcaaatttgaatagagaagcatgggtttcccattgggcctcaactatagaatttaaggaagattatgacctcgttaatgatgctgctgagctagcatctgggttttcaaggtctaaatttatgatgaatggtttaggtaaaaaaccaagtcatgctctagtagcgcttgatatgatcttgccagaagattctcattctcactactacacagatttagttggaatggtttctacttccaaaatctttgcttctcattatatattaaaaccaagatttccaatttacggtggctggaaattcaatttcacgatcggctggactaatcctttatccaattatttaaaggttctttctgatgaagaatatattctctcagttcctttgctacaaggacctcaagacattttctatgattcggtcaatttatctgtctatcttcctgaaggtgcaatgattgaagaggtacaagtccctgtcatgaactatacctcagatacttcatatgctcattcttactttgatttgacttctggccataccaaggtaactattgaaatgaaaaacttgaatgaggagttgaaagacgcaccagttttcttgaagtatagatacagcaaatctgaattgttgagaaagccagcatcgattgccatttacgtgttcgtagcattgttcagtttgttcttgatcaaacaaattcagcttatcatcacagcttaaacaccagaatataaaactatcatagagccacatatttgttatatattgaagtaacgacaaatttaaattgatatatacagtctatctaacgggagcatagtaaataaaaatatttcaacgatagtttcccgaactaccgtatcgataaaaatgttactcacatcaaatacctctccagataattttttccacaatttcatatgtctgatatctttgagttttcaagatcccaacgtattgacattctgtcaaccccttgatgaaccaaactaacgctaacttatccatgaattcgtcctgatcgagtttttccattatttttcgggacttgtctttgacagaggttttcacctcatctcctgcaagaacagattttaataggtcataaatctctgattttggtaaggattctttgaaggcaacgaagaaatcatacacattgatgaaagagcgggcttcacgataaagagtgaatacttgacatataatagggtctattaattcgttgagttttctgtccagttcacgtatctcatcgtcattgttcgccatacgctggatgactttactcctcggcaagattctttccgagtttaacagattgtcttccaaattagtcctgaagaatgggaaaagtccttgggataacagtccgttattgttgtccaacgtgaatagctcttgaaaaacgatttgtacgttttcgaaatcgaattcttggcgaaatttgtcgcatgcttcccatttactcaaataatcgactaatctgttgttcaacatgtggtaatacaaatcaatcaaattgtaatcgtaaatattgagtttattctccaaaatgttaacgatttgatgtaatttgtcattgatggggttttctgccactaggaagtccacgaaaaattgttccaacgtatcattttcattgttgagcaatgatacaatttcttcccttggagcccttgagttcaccatagtttctacaaagttcaaaaaggtttggcatttagtgagtctatccagatatttctcatctaggaaattaatgttggcaacgtcaatgaatatcgaatacggattattgaaaaaataagacatcagcgagtaatccaagattttcaacaaaagttgaagattctgattggtattattatccatcttttcaagcacaaacttcacgaatttgggggataagtttaacttcctatcgacacaatctaggaaagattgaaagatcaagtttgagtatttgtacccttttgtactcgataaatcgatagtcttcaaatcataactcaatgctctaatgatagactgatccaaattattttcgaatttttccacattggttgttagatttaacacaaaacacacttggatgcctttaattttcaaagtagctttcatgagatctataaactcttgtaagacgttcatataaaacgtctcagtttctttcaaatttataatcaagttcagttttttcttgtaagtgggttgaaacaattggaagacaatcatatcgtataacctgagacttttcataacctcctcatcaaactcttctgttgcgctattgggatcggattgtaatttcaattccatcgattccaacatcttaaagatgactcttttcaacaacaatcgtacatttggagcatcctttggctctatatctactaaaacgttataacaatcttcggtatcagctggtatttcaagtttggtctctgcatcggaacccaaaagaatcaacgtcttaaaatcgttcctagttatttctgatgcgggattggatataagactttgaattgtattggaaatattcgttaccacttctctatcgatagaatctagaatagtgtcaacgctagtatggaaatcagcgtgtagtttattgtatagagcccatctagacaagacactctcatctgactcgagaccatcgaataacttcacgaatggcactggagatgatccattatcgtacgaatcaattgaatctctattgaacttgggagtaaacacaaaactctgtttctgtgattcagcgaatgcagcgagttccattaatgctatagtagcagtatgatcgatcgattacgatatgatctagtatcccaaaatcgcactactgatcttaagttagagctcatatgttttacattttgaaaaatgtcagaaataaaagcagaaagaatcctttaaatatgtagaacacacattatactatgctaaaaaccaattggaaaagtatttacaggggaaaagagagggaagaggacataaataaaaaaaaattgcaggagaagggtagccagtgagaactcttaccaaacgttttcagattcacccttgaatctgggtattcttttaggttcccaatcctgttcgcctaaaccttgtaacctgtagtattcttcttttatatcgaattgtctttggttagccttcatctttaccaaatcgtcttccttcatttcttgaaccttctgatccttctgttggtatctaacagcagtgaattcagataaccaaaaagaaccaagaacgatcactgaacaaaagggtaaaccgaaccagaggaacggattcttgttcatatgtttctggtacctaccagcaagtgacgcttcatatgccagctgttgtctttttgatctgaacttcttaccaccaaaactcattgttgggtgttgtaatgtgctgtaaagtggaacgttattgacatagagtgcataagctaatagtgtatatatatatatatatatatacaagaatatccgaagtaccgtgatgagattgaatttgctgggagtctcgaagaataagaaaatccgacatttacccggccattcaaaacgaccacgtgacacatgtcacgtgcctccaccctctcggaccaaaggaacatcacagccgtacctcatgattaaatgaccttccctatttcccgcagcaaagtgccatttcctatttcttacttccgttgcccccccacaaaaatttagaataattaaaaaaaataaaacgccttcaaaatactcaaggactctcagagaacaacgtacgaaacggaacaaaaaaaaatcagtttctccgattaatttgatcaggtttgattcaaacttgactaagcttacaagacctaggcaaaacgtcgttcatacaatacggactttgaaaccaagagaaacaaactagcactaattgactaagccaataacaaacacaaacaaaagcagaaaagctaaagtaaaaccgagccgaactgaatcatgtaacgcgcacagaatgcctattcgttctctgttttctgtctcgtataatctccgttaaatacgaaattaaaagtcaccgtaagaggcaattctcaactgcacacatgctgcgaattctgtcccgcatttttatgctgaaataggccaaaaacagtcccttggaaacggtatattacctatgtatgttacatatatatagtatgctaaatatatatatgacaacagtatcctgactattatatgtatcgtctacctttctcgggcttgaggttttaacatttttttttttttgtttgcgagtttcatatgactatactaatttacatggacggctccggattaagtttaggtctcggttccaaacttttttagaaacggttcgtcttattattaagtgttgttttctttagaatataaaggttcctccttttaaattgcaagactttttttggtgtttgttttagttttaagcgttgagaaatacttttttatttgacaagtccgtatttatatcataggggagtttaaggctagatatatattctgtcatgcaagctgcctgttcgaatattagcagagacacacatgcgataggacagatgaatatgacgggacttcgcggtaagaggaaagtacagagtcagagtcaggggcaaaaccaagcgcaaggcctgacttctcagtctcagcagctgcaacattttttgtctaatcatgatgacgatgagcatgccgatatgttgatgctgccacggagtggcaacgttagcgcggtcactacagctacagctacagctacagctgcagcagaaccaagctcactaccggcaaagattacgaacaataccaacaagaaatttgatatgttgcccgatcatctacgattgaacggggtgactcccagtgggaagccaaggttgttcgtttgcaaagtttgtactagagcttttgccaggcaagaacacctaacgagacacgaacggtctcacactaaggagaaaccttatgtttgtggtatttgtgagagaaggtttactagaagagatcttttgatcagacattgtcaaaaattacacggtggaaattgtggcgattatatcagaagaacttcaaggaaagtgcgtagggattcgaagaaggataatggagcagtgctcgatccttcgtcttcgtcggaaactgatacgcccaataatagcactgttagtccaaatagtgatgtttcctcatcggtaactcctgcgaccacgaaaagggtccgtaaaaggtcgatcaagacggaatatgctacgagcagcagtactgcggtgaagaaagctgcgaaggcggcagatgctgctgcaaaagccgcggccaagtcggcagcagcgacgagtagaaatgtgcctacgtctgatgaacccattggtcccttgctgtctggtagagcagggaatgaagaagacgttatgtcaaagaagagattgaaagtgcacagaagagtttcgttttcggcccagtccggtcaaaactacgctatattacctgaatcgagtgacttcacgcaagaaaagcctgaaagggtcgatttctcaacacctcagatgttacccctggatctattcgatactattccgcagtttgatgaaccaacgaatttcaatcttttggacagaaataactggattaatgacttcaataatgctatcattccaggtacagatgaacaactcgtatcgcacactcattcaaactcagtatctgaatcttctccaaattctaacaatacaagaaattcttcttgggaattacaaggtgacacgttgaagataaactcgttgttctcgttccccatgtctcagggagaatcgcaacatgcaggtgctgactggaaaactttggcaagagctctgaaacctgaactggaaaatcaggactcagctaataaaactgctactgaacaaatcacaaactctttacacaactttcaaattaaattcaatggtaatggtgacagaaccgttgatataaatatcaatgccagtaattcaattaacgacaatgtggaaaatggccgcaacactgttgatccatgtctgacatcaaatcatatccagaaagatgttatttccaacacgattcgtcccaacgttaccatgacccacaatggtatccctacagaatcacctccacttagaaatgattctaacctgggcaatgacttcaagttcatgctcccatcggcattcactccttctaatgatcccctggataccaccaactccgctatcaaaactaataattctatcaacaatgatcataacattgctcatgctcatgataaccccacctttaatgatacacacgaccaagaacataataacacattaatgaaaagtactacatctccattccctgacattcacagacaaaattcattgcatcataatcacttgcatccttctaacgagttcccaaatacagaaattgatcctgctcagttacaatctatcatggatccggggtacacattttatgatgttcagtactctcaactttgtaatatatcaaaggcttctccaaaagatcaagacattaaaatcaatttcttcaataatgatatcagaaacatttgcgagaatgcgttgatccattattcaagcatatgtggccctagctataaaccttgttctttgacttgttccaacgatgagttgaatacatatttaaaactttacatcatgcgcttccacccacataacccgttcattcattcatcggtatggtcatttgattctgaagcgtacagatcttacatttatgaacatgatgcgaaaaatattccattcagtgtagatgatatgatctaccatacaaacatcatatgcttgcctctatttgcagctaccattggttctctttataagaatactacttcttcttctacgagtaagacaagggaattgtatgaaattgcaaggagagtactacacgtttacttggatagaagaaaaaatttgaaacgggatgaaacaacgtcaccactcaattcgaatttatggttgatccagtctttgacattgtcagtaatgtattccatctttgctgaacatagtaactccgatatcaacagatcagatcaaatattgaaacaagttggagcagtttgttctttgttaaggaattactttttaccgttggttcagcagaaaccagaaaatttaaggtcggaagctgagataataatatgggaatcaaaattaagaacaactttgacaaattacaacttgtgtcagtttttacagattttccatagattatcctcgtcgagcttcatcacgaattttgaattacagacgataatgattcctaataatgaaacgaggtggtcaactttatcattcaactggaatagtactaccataaagtccgagcatctttaccatttgaatttcttacactttttccaaagtttccagtttaatgatctaggttatcatactattccacaagttttagtaaattcaatgcttttctatgagtactcaataaaattatctgggtcaaacatgaatgtgttcatcaacaaaatcgatactaagaaactagagaagaatttaccccaaatcgatcaggattctgctacatcggactgcttaattggtgactccatcaatttaaagaactctttgatttctttgagattgtttgataaattggactcccattttttcagaataatatccaaatacggattaactgacgatattttcgagaattgtttgtcacccattcatgccaatattttgtccaaaaattctgattctttggtaattgatttgttggtctcagttaatgcttctatcaaaaatattgcatcgttattttactacaccaatgagacgggatattatgaagaaattaagtttgattactcaaaaacctcgttgttccaaattcagggttatttcttcaatttcctttgcattttaaaattcatattagactttgaagccactccaaatttcaaggtgttgagtatatttgcggagttacggaaactggtagagcagttaatgattccgaaacttgtccataattaccctctggagttttcaaaattcactgacttaaagacggcatatgatggaccttctccacaggctccagctgtccatacgttcagtcttgaacatttggaaaagagcatcgaatcagttttagtacaatcattcaatgactataactatttgaaaatgccagttggtcctgtcaattcgttgaatgaattcgaatttgattcaggctacgctgaaccagctccaggacccagcaagtcatcaataaacttactaaggcaccacgatctatgtaaacagaatggtgctagaacaagacagggattttatgaccgttatcatctatcagacaaattgttacaggttgccaaatgctctttcctcttgatatatgaatcacatgtacatggttcattattgacaaatttcattgacataattaacactcttcagtcaaaattagacaatcaacgcaaaattacgaatattattttcaatgaaggaacccatctctttggaagcaacaataatcctgtcaacgatcacactcattcttttgttaacatgctgaatttgccaaactcaaacactcctcctggagattactacttcaatccgaattccctatgactaccgtaatatttaattaaacagctttttgatgtatgagatctcacgaaatgaccaaaaaaaattcctatagtatactatttataaataattgaacagtatttgttaatcccgagaatataatgtaactcttatttattctactttctatcagtcgggtcaattattgtactcttactgtgatacacttttattacgcctcttcattaattacggtctgaaccagccattccttatttttgatcctaaaatcatttataccctccatcaggaaccttttagaaatgctattttcccagtcggatgagttctgcaaagacgtctcgttgatgaaaagtatcatcttcttactgtggtaattatgccgaaattctacaagttggtcgaacagatcatcgtccaactcttgctgtggtttcaacttcaagtttttcgtgtattcccaatgaccaactttaaacacctggaaaatgaagtccacgaaaaaattcatatcggagtctcctaaaatcaatatcgagtaatcttccaaaactactctggcattgtttagttgtgcatctaaagtcaaactgctattgaagtttgtcaggaaactaaaaacattgcttgatttgataatacctagattgaagtcagccatcaacctgttactttctccgctcggcaaaagattttgtagtatcgtttgagtcgagatataacctttgtttatgcatgactcaataaacctccaatgtagtacaggccatcccaaagccaatgcttctaaatacttcggacttcttgaaaagtttcccgcaataagacaaccaaaacggtaactgttaaaacgtggattgttccaactaaactctcttgatctgtcttcatatcttaacagactttcaaaccctacgctggagacatatcctccttgtatctcgattagataagataacctttttctatccatatcattaagtccactcaatacaaagatgcacttttcgaaaacagaacctccctgtccttctaatccactcattatagtagtatcatagaaagtgtctctgaaaatctctgaagttgacttgttataatcttgagcggttttcttcataggagaaatagaatccctcactgatcgacttctaacagaacgtctcaattcatccaaaggatcattgtcttcatcttccagttttattttggttcgtttgatccactccccggtggtaacgtatatggatgcaatggtatctacaatatcattcttgctgagtcttccgtttctcagtacctttcttaaatgcaccgtatcatatcctctaatgcatcgaatgacatcttctttttgtgggatctggcaatctaaagctacgacttgatattcattcatcttccagtggactttatctccacatctaatatctaaatagtaaatgtcttccaccctaacatcattttgacgtttctcgaaaagaacggagcaatacccaggcttcgtacgctgttcggaaagtatcttaccaggataaaaattgcaatcattaaaataataccagaccgcattattgaataaaacatcttttttagtcaactgcatttcatctgatatacgaagttctttcggcaggtagacaccttcagtgaaagctgtaaattgtgtcattttacttggtgtactactatcttcaaattcttcttctaatattagctgcttgtttttccgtttcttggatacattaagttgttcttgtgactcaaatgacggtttgtgcttgcactcattgcgttcgaaaatttcaggtagttcctgagtttgttcatattcctgatctgtatccagtctcgagagctctcttgagacatcattcgtaggattatgttcattgtgtttacgttggttcaaatcggtagcatcattccggacacccccaatttgttcatcctcgtcggatatctgactggatggtttgacataatatgtgagtttaaacttcatttcactcgagttttcatctgtttgttccttctgagaagattcattgttcatctcaatagacgagtgacatttggctacttcctgatcttctttttcttcttctctttcttcttcactaaatactgttgaaggtgatttattggaggcctgctgcatgggtcggagattaacgaccgctggagaatgaaccaactggatttcttcgttgaaattagaacctgtttccttttgtgtcaatatagttctggtagaaggaagaagactgtgatgaaatgagccaaaattgattggagatgtatgcactattgatgtctcttgaagtgcagactgttcatctagtttcaataagctctctgagacatcgaggttattagactgagttctaattagctgagtcatcttttcatcggccaatgtagacctgatttcttgtgtttgacttacattagctgaattcgttgcaggtactaacatttcattagatgtttgagttacattttgagtgtcaatatcacccaagatattaccattatctgcatccttcagtgtcattataaatggttgtggatgcccctctggggacgagttgatattttcaatcaagctgatcggttctgaagctgccttcacttcacctttagcattcctaagtgagcgaatcgatatcttattctttaatggcgtgtctaataattcaggttgatatgtgtcattgttattcaaaagaatacctttagtttgagtcaaatcaaacggtaattccacttcgatattcaagtctttctcctgaaatcgttgcaatacatcagtctttgattggatatcaattcttcgtctaatctcgagatctcgatttccctcaggtgtgtcttctaacagggatttattcgttggatttaaattgagagcagtattacccaaagcctttatagccttgttaattcccgtgagcgttcgggtgcttgtattttcttttaacactatttcatctgaggaagtagactctatcttgttcgatagctgttttcgatctggactgtaattgggagtctctttggtaataccactgtcttcttcgtctcctgtcataccatatgaaacagcagatactgatattgatggttcagaatgaagtgatattttggctccgtatttttatcgaatgtttaataacttttgttagttgtgcgttacatactgtaaactttcttgttttggtttatgattttctgtcaatattacatttgtagttgttaaagactaagacattaaagagtcaactgtgcgatgtgtgagttttattattatgtatccatagccggtcgcatctcttcagggtattagtatatgagttgctagtatagcactggttgcaggtttgctattctaggaattgattttcggttcttctaaggaaaagtatgatattttctatcgatgggtgtcagacacacatgaagtgaaccttttagaatgcattttttggttgttggcacaaacgatatataccaacacaagaggtgtagcttttatgatcctcgccttaagcaagcataattttgcttctcgtgattagcaccctttagtcggcaacaataactgtgatatcatgaccgacaaaaattcgaaatgtaatggtaagtgacattattaaatgaaagctaacaatgataacgattgaatggtaaatactaactctaatgtcatctactattaggttcatatgttgatgttctactttgttttgagtcgttattggaaaaatgtctcaagacgcttgaagccaagcaactaatcaaagattcaacggaagtatgggacgactttgtggatatcatactctcgttcattcccttaaatcttgtgaaagaacgattccaaaatggtaatattagcaaacagcgtatcatttctataatgcagggtattcttgatcacaatcccgatattgattttacagtggatgcaaattatatgtcggataatctatgtgctagatatgcagatgatcattttgttcttagatggaagacaaacattatcatcaacttcagaattattcaagcattcttcgagcttctagatgaagaatatgggaccgcttttttctctttccgctggattctacagttcatttcagtctctaaaaataagcgtcacagtgagaagcgatcagacctttcctcgtctcggataacatggataattcgacaaacttcactttatctggcaaaatgtttgaatttagattttaatcaagggaaaagggtaaaatacgtgtccttcaattcggttagggtgaatcgtttggacatgttcaaaggcatattatacacaatattggaaaattcaagcagtgtaatatctgcacaacaggacatccagaataagcatatgactgcggagtatttcaagatatgtgcagaaatctatgaatttattgcgctactcgatgggaaagtattagactatgagcacgcacatgatgttaagactactgtgataataccgcaaacagttttttccacttatatgatccgtcattacatgctagctgcagttcatttcccattcgatgaccctaaaaggcttgtatgtttccacaaaatattgatgggtttattttttgtgaataaagttgacttagctactttcaactacttctatggtgagttctaccagtgtgcaaaatccataaatgaacagcactttgtcactgattatgctaatttttcgctttctggtacctttgtgaatataattgagtcagttgcacagaatcatcaacatctcaagcttttaccaagtgtcctaatccggttgtctaccaatgaagtaatagtcgactctgaattcgatcccgtcttatcaaaccgacatacttattcgaaagaagcagagaagttgaaacgaaaagttcgtgggtctgattatgaacgtgataatgttgaaatgggcgaaaatggtaccaataacttcatagaattttggcgacagctcaatgaaagataaagcaaaagtacacttttatataatttttgttatatatgtaacaccaagtcttctatctatatattagtgggaagcagtgttaataaatcgaatcgattaagttgaaatagtttcttttacaaaattactattcaattcatcaagacgtttagaactgtagccacgtatttcctcattgatctcttttgatttatgattaagttgatgctctagaacagtactttctgcaagaatatctctttcatcattatttgacggatagttgttgccagctaaaagcttttgcgttctgtaattttcatatagcttattgtgcgttgtatctttcaaatcttgaagatgagatcctaatagaatgttcttcaaataaatgaaatcacaatgagccctattttccacttttacagttccccaggagtaccttctcacgtgaaacagttctccatttggtgagacttcaacttcattactaccaattatcgaaaatggtaacatatccctgattctacagcaagctgtattcaattgggctgttccttcaccataactattttgctgcatactgtcaaaagaagtgttattaggaattggactagaatcattagcctcgacaagcatcaaagtatcttctagtttatcatctacaaaatcgtagatattgatatcattttcataaatatcttccatgatgagacgtttatttaatgctatttccctttcggttaataaatcagctttgctgatgactgggatgatattgaccttgtcacataacgccttcatcaattttatatctagctcacgaaggccttttgacgttgctctaatgaagaataggcaaacatgtggtctagtgtcaacattttttgggtttctcttgattcttatttcctcattcaacacgcgatcgaactgggattccaaataatcaacaacgacttcatggttattagaattgttgatattatcccccaaacctggaattagaacaatgtcgaggcttattggtgtagaattttcctcttgtaaatggaaattcttggacacaatatcaatgcctgggctcaaatgtgcggtggcaggatcaaaaccctcttcttcgtgtccaaaaacctcttggttgcagatattattgcaaaaagtggacttgcctaaacctgattctcctatcaccaacatgcagaactgtatgcctcttttggcatttttcctgcgacgaatttcttctgcactaagcatctgataattagatttctttttgccaaacattatagctgatgggaaacactgttcactttgccaccgttcgtgaaccttcgtatcttttccgtgcgcaaatagtatgatgcaatgatgtggttctttcttcgaacccttttttatcttttatctgacaacattcttcgacagtgaaataaaagaagcgacgattttgtgtcataaaatagtgcatacaaaatcgagggaaaaaaggtatgaatgagtttgtccgtcaatggagtcgtgatgatactacatagtttatattaattttcaaaatctcggtttcttcgtagcttgttcggcgggtggctctgaaggtctttttatgcttctttcagacatgattctattcgaaagctcttcgatctttctttcggtatagttcaaaagttcttcattgacttctccctcctttatgatgtcgtagtcgtaagggttgaatggttcgggatctaactgtctatcttcatctatcactttgtctatttcgtcaacagtaatggataaagcgctatttttgttgctcttcaaatcgaaaaaggctttttcaagttgttgataatgcgagaacaacgaagcaatgatttcactggttataattactgggaaacgcctcctgaagaagttatgagggaagctgaagcccggttctttgtttttttgaaaggtcacaccagcgaatattagggctaaggccacaagtgtgtatccatcacatagcaatgaaattggctgtgttcctgtttggatgatgaaatttcttgcttcttgtaaaatcacggggaaaatctctcgaagtgatgcatcaatatcagtatctctaacatgtctgtaatatccactgaatatttcctctataagttctttcggattgtcaatgtcaaggtcgaaccctaactgacataacactttcttttcatatgaaacaagttggtccctgacctcccatttcaatttctccacgttcaacttctgaccagttggggacgggccatctttcatcatgaaatcacaagttgcttttatatagtggtcagttggtctgttattttccatggttttgcaggccgtaactagaatagcttgcgccaaatggatgcattgaggtatagtaggcggaagatcatacttgtaccaataacggtagaataatatacatgctgcagtgtaagtatgatcgaaaagtttcatctccttcctcaatttatggaagtacatgagacacttctccattctcttcttcgtcaattgaattttctcctcatcagtacctaaccttttaattatatcagtatactcgaatgtccattcattcttcgggcatttgattatatcaggccaaagatttcttggattgaattgaggattcccttcattctgcttgatgtctaatgacgtcttaccattaccactgggctgggaattagctatctcttcgctggctgaaaggaccatttttaatctgttaaagctcacgagaaattcgttcaaattgactcaaaattcggagtagatatgagatggttggttgggatgaaatgacgtttgtagtggtgtgtacgtctctctttcctgattcaatgccagccagtggattttaacgatgcatatgtaattcactgaataaaaaggaagttatcatgaatgtagggtaactatatatatacatttgtattatatgttgagatcagttgtgatcaacactcatagacaaaatgtgagaaaatgaaggtgtgggcttgaggcagtatcgtagtatattccccaagtcgtcaagtcatcgtgttattctgttatcttttcgtagcaaatccgatttccgtccatgaccaaagctttgagtttctttctatgatgaattttagaatgttttattccgtgagtggatgaactcttcgtcttggcatgagagtcaaaatgatcatttgaattgttctttacctcttgcattgttaatctcatttcagtatctatcgaagaaactgatgaaggtgctggagatgcgtttcttcttgtttctgccaagtaatcatctgacacctttcggcaattaccattattacttgatgcatgggatttcttctccttcaacgaaacgcttctttctttactcttagccaggagccgttcaaacagtacagccttgtccttcacctttttagacgattgcaactgccgtataaattcagtagaagaagaagaatcagaatcagaacttgaaagcgattgatgatccaattcatagatctttgaccaaggctgatctgctaacttaggggcaccatctgaaaatacggaacttcctgaccgcgaatgcgaaattccaaacgaatcgggagaatgggcatgattagaatctgatccagagtcaattctttttagtaaagagcttattgtgctgagtggggtgaattgtacatcatcgagtaagttgccatatttatttggagtcgcagaggtattatgtgtaattatcctatcaggtgtttctctcccagaaattacaccaatcctatgaaagccttccaaaactctcaagtatttcaatccttccttatcgatctttgtcggcttagtgcgtggctttttagtaggcgtactttcactatcagcaaagtcattcatagatatttgcaccggttgaatttgaccatcattataactatcactcccagtatcctcctcaaaaactgatatattttcagcgtatatttggtccaatccattaacgtcattagttgtgtcaatatccgactcatcttcagtttcccagagatctgagttgtcgggcatcatttcaccatcagttctcccgtcattaatgtatttttttcctactcgctggttctggctatcatatccattactttcattatcattttcatcgttgttcatattgtcattgtcttcactttccgatgcagtgtctatttcgtttatccctaaatcatcatttgattctaacagtctcaagaggttccctgagaccttccttactccattatgcagatatcgcagggattgaaagaatgttgtgtcattcaaagatacaaaatcgaaacctcgtctattcctttgtaacatccttagcgaatctaaaaagtatcttttcgtccataaatattgattctttgggtcatgaagtatactatagtacattaatttttcattcgtaagaattcttaacgtccagcatgtggctgacacattctttaaatcagagaatttgagctctgatagtatctggaatataacgtttatcggtagctcatctaatgatttaggacttaccactagactgtcaccctcatgcattttaccagagatttccatttgttgtttaatttgtattcttgttctgtttgtacccttaaagctttaccgattcttatattggtgttaatcggttggttttgttcgttccccttctttctagttatataagtttgaagtcaattctatcgtctcatagagaagatctctcactattccttacgtgtttctaccactttatatcgttcttagcttctttgtaaaagcaaatcaaccaagaaactcatgtgatacacagaattttgtaaacactagctcctttcaatgggacaaagttcgatgctttgaggtttcattaacttctcatcagtttactcttccaggttcattgtttaccaattaaactaattgggtaattatctatcatgtgacttgtttgatcatgtgacttgaaaagcaagaggtttacttgggacctttcttgtagtcccttgagaaaacatggtgtcaatggctgcctcaaccctcaagaaatgatgttggatcgtagtaagtgttctttggtagctcatgctcttgttttttctatgtgtggtctgcttccttaacgaatctttgagtttaaatatagcagatcatcatgaaaagttatgtatggctcactacgtaaatcgaagaagagccaacccgaaatcccctgtaaggacgagaccataggcaactgtagacaacatgctgttactattgatggtacttttctctttggcatgtgcttccgaaagtataagaggtgtaccaccagagaatcagtcactatactcgcccttaccagaggatccaacaaaatggagatgcctagatgatacagcaaaagtgataccgtacagctctataaatgataatttgtgtgactgctcggattgctctgatgaaccaggaactaatgcctctcaagagcgtgctcttttctactgtaataatgaaggattcactccaagaaatatactgaattataagattaacgacggtgtatgcgactgctgtgattgttcagatgagtatttgcgtgagccgttcagtcgtggtaaatcatgttcagagttgaatgatgagtttcagcgaatacttaacacagaattggaaaattaccgtgctggtgtcactgctttgaagaaactcaaatccaagacgaaagataatacagacgatcccaacagtgctgaaaatgttcattttcaaatagatggattgactacgtactcagtggatcttaaaacagcattgaacaatgtcgaagaaaatttacaaagtttagaggaatcttacagatgtaaactctttgaagaatcgccacaattatttgaatacgagaacttaaacgttacttttatcactgactcggtagtgtctgtgttctctcatgctcaaatgttatcaaatgcttttaatgaactaaagttcatcttgaataatttatatgaaacttataaccgtaaacttaatgataaagtggtaattaagaacatgaagcaatttgcagaattagaaatgaagtttaagaagtccttccagcctgacggccgcttggacggtactcagcgtgaccaaatcaatgaatatcttaatgaagagcttccaacatttttatttgagggtaaaagcaaatatactcctgagattatcgttgccaaatctaactttatccagagaatcattaacgtcaagtataaaaccaaggatttaactcttgatggaataaaacagttccaacaaattgcagatgatataattgaaaatcatgacataaattttcaagacggcgcagtgaagagcttcaccgacagttatatgtcgttcatgtccaaatatgaggattccctgtacgccattgatttccctgagaatttcagtgacacattttccgaattattgctgttcattgggaaagaggcaccaaacatcgcagtcgactcaggaacggaaggttctgactggggtgtaatgaggatagtccaaggtgcattcgatcgtatgaactttttctctacttcattgcaatcctaccgatcccagatcaaattcatgaaagagcaacgactctcactaaaaaagaagctcagaaagacagaaaagaagatcatagaattgaaacagaaattgaacgaccaaggtggagaatactcagagtcacaattgatccacaaacaagttggcacgttgctaaataatttaaaggatttctgtgtcgatagcgaacttaattcctatatctacagattatgctattcaaacgacaaaggcggtgatattgttcaaatagagaacaaacctgatggtaacaaagttgtgataggccgttatagaggcttcacgatcgacaccaattcaaaatatgacgtttaccttcaaagcttgaaatataggtatccaaacacagaagttggcaaccatttatcaagtgacactgtcgaaatcggcaaagaggaaatcttgttgggaaatctacctgatttgaacaatgggttaatattagagtacagagggggtactaaatgctgggatggtcctttaagatccgccacaattcaaatgagatgtgcaccggatttcaaaatcgagtcggtttcagaaccaacgagatgttcttacgtatttgaaatgacaggaccattaggatgcgatcctcatttccattatgaaagaccaaactggctaatataacgaatgaatcagggctgattattctctgtggctgtaacacctcatctatctactaattcctagtccaaatacaggctatataataaacgcttttttcctcgctgtgtgtgcgcgcttgaacgtaatcatatgccggaataagctttttaacttttttaaattttttttgtacccctcggtacctgcatgcctttctgccgcaatatctgcactaaacgacataaaaggaagaagaccgttttttgtggcaagtacgacgaaacaagtgaaaaggcattaggtaactaagggaactgggtcaattcgtatagtaagtcatgctctagaagatttacgggctgctggaaatgtcaacattctagaacttcgccgcagtcccaaaaaaaaaaggcgtaatggtaattgaagaagaaaatcttcttggagatcccttgtacgcaggattggacaagaactttaaggaattggagctgcctatttttccttttttttcacctctaagtggcatggaaatcagtgtactgtgagctatttcattacgtgcaaacggaaagcggtgcccttttcgaatctacgggttaagtccgccccccgcacccctctctctccctcaggctcctttttttgagtcgtacgacatgtcaaaacggatacaaaaatggcaaacgactaatttttctagcaagaatatgtttccgcattagtatgtgtcaatatcagttgacagaacctatataagtattctgtggcatttcaggatggtttttttttttcagtgtaaagccttttagaagaataacatatccaatggcaggtacctaagggagtactgcaacaacgagatttgagaacggattacagcaattcggttcgataagctaaggaatgggatattttcaacctgttggtagtgtcgctggaggtgaagaaatctatgatgagatcaatgacgttgatggattcagttggcaaacgtatcctcatgcgaaccatgatagcgcacttgggaatgcacttgcgaaaagtggtataacaaaaagcagttctcaacttataaaaaagggtagtgctaccaagatcgaaactcaaacgttatatttttgtgatcaagatagtggatactgtggatttatccaattcttaaacagcagtgtcctaggagggttctacaagtcatttgaaatgaacatcaaggtgtttaatgtagacaaggaccgtactaatgactctgggagtgataatgctagtgagtatatcgattattggaagaacgtcaaattaaagaagccatctgttttcaccccgttagaagtcagcaatcagaacatgcggttcatatttcggaaacaatgtgaccccagttgggacgaagatactgttggaaagaaacaacgctcacgcaatttttatcaaggagctgaagcggttccgaatgaatcaaggataggcacattaagtgtcgaaggtcaaacggaagagttgtccatcagtttagatgtgaatataggcaagggattcaagatcaaacccgatggtaggagtttcttctcgagagttcccatgaggggcaacccaaacgtcgacaggtgtatcagacatgtatttgctccgaattgtactggatcagggcatatagtggtgaactcgaaaaagataaaatttcactcagtacctatggtcctcatcactgcattgcaaggccttaaacctaacagcgctgccaaatcgtggaatttcgctgctttcatgtcacctagacggacaattttatgtatggagtttacaacgccaaaagaatacggtgaacaaacagtgaccatatcgtcggacacaaacaagataacctcatcacagcgcatatattgcggtatacaggataaacataagcatgtgaaacattttgggctaacactggatcccaagaccggagtagagtatccaaacatcgtagagattccgttacccaaaaaagacggtgaactatgccccacgttactattggggcccttaaatctaatcaatgtgtacgatatattacaagagatgcccacggtattgaaaggcattgtggaaaaggtggaaggaatcaacccatatctatatcagttctgtcaaagaaccgaggtagatgacgaacgtgcaatatcacttgtagaaacaacatttataagtccatagatccaattcagataaatttaaaaaatgattaacagagtgaatagatgcgagtcgtcattaatcccagacatctgatctcccatatccaagagtcaaacgtcaaacgtcaaacgtcaaattacgtatcttggcaatcttcaaacacagcagaacattacccggtacaacaaaagaaatttttttcctcattatcttctcaaccaattttcataggaaaacagagaaataaaaagtaaacttagagctcatctcaagaaattgggactagaataaaatagtgtgtaaaaaaagcagagaataaccttgtttctgtctttgtctctgtctttgatcaaatcagagtttctcctaccaacgctggctgtaaagatagtggaaaattttacgtatctaggttagaagtgcagtaagatcaggaatattcaggaatagatttccctgctcttcggtttttttttttttggtttcattctactagtcgtttatctgcgaagagaaaggataaggaataaggaataaagatttgaattgtgtgtgatcccaggacacttactgttgattagctagttattaaagattgtgttgaactggataaaacgttttataacctagaaattttttttttcttttggttttctttttattaaattgttgagcctattgatttgatccaggtgcatatagaaaagtccactaaagagtagaataccattattgcagctgctaattgcaactgataacacatatatattatgtcaggtaaaagcccgaggaagttaactagtgggaagaagcctacgactctgaaagcgttacaggataaaatgggaaataagaaggataagcctccgcatttaagttctagaccgagacgtttcagtctaatatattctagtgattcgtcgctgagtgatataccacaggattcgaacagcaggggctcgaatttgtccaagttaccgttatataagaatcccaaagccggaactaagctaaaaggtcgatcttcgaatgcgatgggtaagaacggaaagctgatatcaacgaatcaggactcagccatcacatcaggttcggacagtgctacagcgtcttcagactaccagtctctctcggaggatgaaggaggtacaatggcagtagatgatgacgatgatgatgatgatgatgatgatgatgatgatgacgatgacgatgatgacgatgatgatagcgacagttcgagtactagttcagacgatgacgtggattttgtgagacttactgcggaacgtaagaaaaacgcaatgaaacagctgaacgctttgaagaggggcaagacacctgcagaaactgtcgtcagtaacagcaacaataaaggtaatagtaaacagggtggatttcctaatagggctcagcagaatcgtgaagcttcggattcgaatgatgaggacatttcaagctctgaactatcagatgctcctgaactgtcattcaatttcaaaggcgacgatgggatcaagttcggtgatgcttcagtagcctccaagaaggctgatgaagatttaggtgaggaagtcaaggataaagatgtgaaacaacctttagattccattaaaccaaatgtcgatagattggcggtaccgaaattttcagatagtgaggattcagattataatatcgatcaagaggcatatttcaagaccattgatgatgataacgaaaatattaccggtatagataacggccttgagactggtgatgacgatatggctattctggatgttgaagaacagaatatggttaaacagcttgaacgtgatgatcattcttctttcgatgattcgcaggtggaatcaaagtatagagatgggaaacccagaaatgacgacgatgattacgaatacgacgaggacgatgaagatgatgcaatcatgagtgatttcgatatgcccttttatgaagatcccaagttttccaatctgtattactatgatggcagcgaccaacccttaactttaagcacatctttaccgttagtgttaagcgaagagaagcgtaagagggaagagcgtaagcaattaaaacagcgggaaaggcaggagaggttgaaaagaagaatgacttccaagaagtctaaacgtgaacattctgctactccagatcttgcagaagatgagtacgtatttgggttatttttccaaagcgatgacgagaaacctaaagttaccaatgaccttgaatctcctttgcgtaggctcagtaccgtggcagtatctgataaagagctttcatctggagatgaagagtacgaagatattctattagatatcgcccacctccctacagatgaagaggatgaaaatggcttggagctagacgaagtcgaaaactcagatggtgaagatgactttgaagaagatgatgacgatatgagtgtcaccaacgttttcattgatattgatgatctcgatccagatggcttctactttcattacgattcgttatcagatgaggaagctggagaagctaagagctatcctgacactccagatgaccatgtggaaggtgtcatctttgtagatgacgaatccactgatgaagatgacactttaccacctccaaatacaagacgcaaaattgggactaaggcaaaagaagtcgttagtgccaacgttgttggtttgaagcctccgaaacttggaacttggcagacagataacaagccctttagtatcattgatggcctttccactaaatctttgtatcctgctattccgccagttcaacaaattttagatccaagaattgaagtcgaagacgtttcatcacataatggtatcggatcaggaggcgaaaaagaggaactaacccttaacgaattgttgaatatgagtgagcttgaagatgaaaacaatgaagatggcgctgactcgaattctaagaataaagagattgccacctggtatcacaaaccatctgttccattatctgctttcagaaataaaggcatcaacttcgaacatcaagaagacgaatacatgcttcctgtgttttcagcacgcaagttcccaattggttacgttggtagtgaaaggactagaaggaagatcgataagatgaaggaataccaaagaaagaaagatgaaaagcgacggaagataaagaagaaaaagaagctcttgaaaatcagaagggaaaggcaaagaattgaaaagcaaaaattgctcactgctcctgaacaagaaactgaaactgaacccaacgcagattctcacaacaacattcaaactccctctagcgtgaatttggctagtccaagttcaagtgttttcaccgatgcagatgctggaaacacacctaatgatttcaacggtctggttttaccaacgaggaagaattctgtgaagggattaggaatggatgaaattgatcaactgctgaaatctgatgatgatttaatactttctcatcatggagatgaagatggagatattgatctattaggcagtgacgatgcagatctcctggtttctctgactgccccgattgaagaaattgattttaaccatgaacaaatgagccatgttgccgcatggagaagaagaaacagtatcgccgaagctgctgctgaacatatgagagtaaccaagaatggacttttcagtgagacggcgctagctgatctggaggaaatcatcggaggatcaacagaactcccaagttaaccctcattttcacttcctttgattttattttttattccttggttttaccactgctgctgatgcgaaactactcgactaaagcataaccataaactacaattatctgtattctacctactacactttcttggatataatctacatagatatcattctgtgaagctctattcagcttcaccattttttccgtaagaggagtgttgtacttctctcataaatcaacaattaactttaaaatcatatccattagaatattagcaaatatttagcaaatatgtgtaagtgcaaataaacattgtctaaagaccgttcccggttttcagctcctttgtatatgttcaatctctttctgtttcaagcatatgataacccatgcctcattgtctacgtttttttcttttttttgttcaattcgaatgttgaaaagtttaattcatctcatctcatctcatcgcatcacagaaatatgctaggtgaaccaataagattatacctggccaattattagcacccaggacagcaccttggatctcccactcgcacaatggatttgagaactacctatgcatccacgaaactagagccgttttatgctggtactggtgctatagcatctgtttctgaagatggacgattattagcgacttcggtcgtcgataaaatcaacattgttagcttagatagcccacgccgagtgttgcattctgttgatactgaggatgaacaagacatcaccgcattgcatttaactccagatggttcttatttgtgttttgtctcacaagcgcagttgctcagagtgtattctttgaaacaagaaagaattatcagatcaatgaagatttcgtcaccggtgtacgtcatgaattgcgatcaaacatctacacttttggctataggtggtactgatggtagtgttagtgttattgatattgaaaatggatatgtcacgcactctttgaaaggacatggtgctaccatttcaagtgtaaagtttcacggtgagttgaacagtgaaatttggaagcttgcatctggtgataccaacggtatgattaaagtctgggatttagttaaacgtaattgtcaatgcactattcaggaacatactacagctgttagagggctagatttccgtgtcactgatgaagaaaagggaacgctgcagttattatctggtggtagagacaatatcttaaatctcttcgagtttaattcgacgaaaaagtataagctactgaagaccatccctgtcatagaacaggtggaatcgtgtggatttacgcaggacccggatgtggtttactcagccggtggtggtgccatttaccaattagtgtccttgtcaacaggaagagtattaaagaaaacagcaaaacctattgaagagctatttattattggtacactatgtatcctgaacggaactaagcagtacttggtattttcagatcaaactttgttcctaatagatgttgaatcagctttacaatcggaatctgaagtaattgaagtggaaaataagattgcaggtaatcatggtaccattgcagatataagattcgttggtccaaaacgggataaattagcattagctactaactctcctactcttagaataattccaaccccaacttcttcggaggaagagttcgaaaatggggagaacaaagaaacatttcctattgaagtaaagatgtacgagggtcatacggatctactcaactctttggatgccaccgctgatggtctctgggttgctacagcatccaaggatcacagcgttatattatggagatatcatgcaaagtacgaagacttttatccatacactaaatttgtcggtcatgtaggttctgtgaatgctgttggacttcctaatgttatgccacgttcatggcctgaattcataattacagcttctaacgatttgaccataaagaaatggaaggttcctaaggtgacatctgatgaacccgaagatctaatacttgttaagacctcagaatataccagaagggcgcatgaaaaggatatcaatgctatctccatttcacctaatgattctctatttgccacggcttcatacgataagacatgtaaaatatggaatttggatgatggtgaattccaagccacattagcaaaccacaaacgtggtctatgggacgttgcattctgtcaatatgacaagttattggccacatgttccggtgacaagaccatcaaaatttggtccttagaatcatatgccgtcgtaaaaactttggaaggacataccaatgcagttcaaagatgttccttcataaacaagaacaagcaactgataagtactggtgctgatggtttagttattatttgggatctatcaactggtgaatcggtcaagacactagatgctcacaataaccgtatctgggctcttgctgttatgaacgatggtgaatccttcgttacagcagatgctgacggcttctttgagttctggagggataacagtgaagaggaacacgaacgtaacctcgagcaagagaaactgaagattgaacaagaacaatcattacaaaattatctctcagaaggtgactggactaacgcatttttgcttgccatgaccttggatcacccaatgagattgtacaacgtcttaagacaaagtgtagacaactcaaatgaggatccaaatgtagttttcaacaacgaaattgacgaggttgtgtcgactctagataaagatcaacttcttcttttagtgaaaaggtgcagagattggaatacaaatgcaagaacacacacagtagcccaaaagatgataaggtgtattcttctaagacaaaatattgaagagttgagcgaaattcctgggcttgtaaggatcgttgaatcaataatctcatacgcagagagacattactcaagaatggataacttggttcaagaaagttatatcttagattacgctttagttcaaatggacaaattgctataaagaatgtaaatatagcactagtcgtcatgtagatatatacatataacagtacaacacacccaccgcatcaactctgaatagataccatatccagtcaagggccatccatcagtagaataataagtttgttacccggctttgagttttagacagaatttgtttccctgcaaaagaaacttcatcaaataactagacgatgtgaagcgatgagatgagatgagatgagatcggctctcatccttcttctgttaaaaggtgacttcaactgtgaatttttgacagttatactttaaagttaactctcctccatattaacgagaagctctatcggaaactatcatgtcagagggacatattgcagctattagcaagacgaacaagaggaagaacagaagaaagaagagaagaacgcaagacgtgtccgactcaagttctgattccagctccgattctgaaaattcatcggtagaagataatgatactaagctcgaaactgtggagaaagctgcatctgatgttgaagatgtaacgctttcagatattgacatggataaagaagaagatgaagctgcattggacgataaaaaagccagccgaaaagagggaagcgtcttgtcctcggagactgtggacaaattaaataaagtgggactaacaacaagcgatttaactggcaacaatggcattcatctagggaatatcgatttgaataagatgtctgctacgttagatgaaagcagcaataaattgctagagaataataaggacaagaacggattaaagaatcaatatttgagtatgctatttgagagttatggtgatgacatgaacgaattgagaaacgcaccagatttcacttcgaagacccttgtcatgctagcgaatgttctaaaagacggaggagatatgtttgatttggagaccttgaagacaatagtagaggataaatagtgtttggatctatctagcattttaaaaacacatgtataataaaataaaaatacaaaccatctatcacgatacagctagaatgaatcaaataaagtctggacggcaaattgatgatttggagtaagatatgaatacgtattggaatgataaaaaaaaaagtacgtgatactagggaacgcttaaaagaagaagtaaaataaataagagatgatgaggatgattatgattaattaattttgttttatttgtgactctcattcgatgaccttaacgaagaaccaagctgcacctgcagcagtcccaccgactgctatcatttgtaagccttccagtaactttttctgcagggtacaatcgttcattgagacttgggatttgaaatatccgaaccagaacaacgtgaaagtcattaatgcaatagagatcaggagaccggttcccaccgtttcaacaaagaaatatggtattaacgggacgaacccaccggcaaagtatcctcctccgatcgttagtgcactaatccattgtctattatcatcgggttcatctaaacctcttccgtatttgataatgaaatccaccataagttctgggtctcgttgcatatctttcacaaacgatatcactgtattttccgagaattctgggttcatttccattagtatatcttcaatttcatggtttattagctgagtattgctataaaatttccttttttcttgcgacacctccgatttatagtaatcactttcagatttagcacccaaataaccaccaagacccatagatatagcaccagagatcaattccgcgaacccacctgtaatcaccaacttggaatctcccaacgaggaaagacctgcggtcaacgcgaaaggaaccgtcaaaccatcactgagtccgataatcatatcggacataactcttggatcaatcttaccgaacaatccagacgtaccatcatcctcattgtcataatcgtcaaacccacctgtatgctttgaggattctatatcgccatcctgtggtgaagccgagtatcgatgactattcaaattagtggtagaattcgaattggaattagaactatcggatgatagtaatggaacttcctgatttttcgctacgagttttgacacagcgtttttaattgcaaccacggacatgtagttctagtttctgaatatgttataatatattgttattctggtcttatttttaccaaatagttaaaattgtatagcagagcagtactgctgataaaccaatatctacaaataaaaccgttcttgtgttttgttccccacttattccaggtttgttcccttggtttcacttctcaaaaaatcacctcaactttattttctttgaaaaacgtctatgagaattcaaatagatactgcgagtgcaaacaaaaaccaaccaacagctcaagcaatgtgtctgacacttgttccaatattgtttctctaaaaactaaatacagaaaactgcgaagaagtgcttataaaaaagtgaataaaacgtacaagctttatataaactttgtatagtaatatatatatatttacaatgaattgggaaaaaaatgaaaaagattacggcttggcaaatagcgccgctggggcatagtagtaaaagtttaaattccaaatcaatttgaaatccgttatataacggtgagtagtcccacggtttcccgtgcctttgaaaacctgtgtttctgtgtggctggtaacgtcagcattacgcacggcgatttcattggacggcagaggaaaaaaagaagaaaatttagtgtcacgtggggatgggaagcacgtgacagaaagtcacgtggtttgtcatatatgtaacaacaataccaagatgtcttcgacatcttggtattgctctaatacattgatcaacagatgcccgaatggcctatttgtgaagaaaaaaaattatattacacacgttatacccagataagattttaatttacatatggatcctttgcaggatgatgatgatgataatgataatgacaactcgcctaccgtttaagcttgagtagaagaagagtacttggtaacagctctggtaccttcagaaacagcgtgcttggccaattcacctggcaagatcaatctgacagctgtttggatttctctagcagaaatagtagatttcttgttgtaagcagccaacttggaagattcagtagcgattctttcaaagatatcgttaacgaaagagttcaagatggacatagacttttgggaaataccagtgtctggatgggtttgcttcaaaaccttgtagatgtaagaggagtaagtttcctttctagccttagttctcttcttagatggatcggtagaagaggaagtcttcttagcagctggcttcttttcagctggagccttggatgctggggccttggatgctttagcagacattatagttgtaatatttgtttttagtaatgtgatagtactggttttcaaataactagtgcttgtcgagggtgaattacagaaccatatatatttctaatagaaacggataatctataaggagaaagggtaaaagtatccatttagtcagtctctttatatacaatttggttcttcgccatagtaaaagcgatttgccttccttaaattgtgtctttggtacttgttttttttgtttttcacgctaaaaaggcatgtcatgaccacagcttcgctgtggtaaaccggtttactatggcggatggagatattctccgcgcgtaaccggtagcacggtctacgaaaaagtttcctttttcggaaacaaccacgggagtccatagtaaaagggaatccgttgattgtttgaaaaaatggttcctcgacatctcaagagacaatatattaacattccaggagtttcacggcacaggtgaagctgtgagaacagggggtttgttttcgctgccgctttttctttttttacttttgttgtgtgagcgtgtgctttgctcagtgacacagtggcactaccgtgccaccgtttcttatataaagaggtcacttcttgcactttcagttcctcttctgttcctagtttagctcttcgtattgtttgttgttcatcatcacagatactactaaatcaaaaacaacacacaaatcaaacactataatacaatataaaaaatgtcaggtaaaggtggtaaagctggttctgctgctaaggcttctcaatctagatctgctaaggcaggtttgactttcccagtcggtagagttcacagattgttgagaaagggtaactacgctcaaagaatcggttctggtgctccagtctatttgactgccgttttggaatatttggccgctgaaatcttggaattggccggtaacgctgctagagacaacaagaagaccagaatcatcccaagacatttgcaattggctatcagaaacgatgacgaattgaacaaattgttgggtaacgtgaccatcgctcaaggtggtgtcttgccaaacattcaccaaaacttgttgccaaagaaatcttccaaggctaaggcttctcaagaattataataagcctgagcaaaggggggaaaaaaaagaatggaatgcatacaaattttattttaatatgaaaacaaaattcatcgggtctgtcactaatatatctttcttatgtttattctgagttggcattggcatcattttaaacacacaaattactttatcaaacaaggagaaatggggggattctctgtttcatctctttgtatgggatagttattttttatttgtactatattttaaatatatatataaactacttcatcctacgttatgaggtatatctttaatcgtcatgaatttcgggttagattactttctttcaatgactttcaattctgtctgtgttgttgattttgacacattattgtccttttcctgtcttttaacattgaatattcccttgaatgtattttagattaatttggacaaagttgttttagatcaagaagagagtagaaaagaaaaattaattactattaacggtataactatttagtgttgatatgagtcttattagatttaaataaccttttgaagaacgaacctttctcgttcttcttcttgcttttcgtcttctcattgatacgtggggtgttatcgatggagggggacgaggctgggatcacgtgatcgggattgcctggttcgtttacatcgacaggagtagcagcagtgctagctgctagcaccgtggtatcctcagtgacgacaacggggttcgccccggattcgtgtcgaagcgaagaagaagaacttgtgttattattgttattgtgattattgttattgtgattaatattatgaccactggcattagtgtcaaaattgtcagttgttccattggacggagcgacgtccggtggttgttgagaatattgttttccacggtgttgttttggtggttgattaccagagttctcttggctgaactggacaaccctatcgagtatactcttgacttttttctttggatgtcggctcttttcatttgttggaatcgccgcagtaggttgttgcaattgttcgtgttgaatttgttcctcacgcgtgggcaagtgcagtgtggtcgggagcacatgtggttgctcgacatctgcatcttcaagtatcggtgtcatttcgtttctagatccattgtctgtactatgcgaaactgtttttgtaggatgaccatatttctgttgagcaatctccaatgctatagcatacatctcctcttggcttagtgtcttctgatcagatgtaggaacagtagggacggcaactgcttcattccgtttcttacttttgaatatggattttcttttcgtggcgttattgtccggtgtagcttgatccgtagtatccttttctggttcaagttgtgcattgggagtatctctcaaagtcatcctcttggacattgtacttttccttccaactgatttcgcttctgtgttctgaacctgcgatataccttgatgttgaacttcttgctgctgctgcaccccctgtttctggaccaggggttttcttgaagtgtatgattttgaattgttatcaacatcaactttattcacttttgccaggaaatggtcctgatcatcttccgcaaatgcacctgattcttcaacgacatctgatgcgtcagtgaagtgctcttccccttcctcttccgaatcacttctgatgttattcgcagctgagttatttatagcattcgagttgaaattggccaatctctggtttgtccgtggttgcgattcggataacggagcagcaggaggagtggcggacagctcatcggagattgggaactcatcattttcagcaaactgctggaaatgaaactgagggtcttcaaccagcccagcagtttgcgtggtagtttccacgtattccatcccgttgatccttcttatagtctgcgtcgtgatcgattgcgttctgcccatcatatctttaacctcttgtgtcttgatgataatagatccgttaccacctccagcaaatgaaccggtccttgaaccaaccctggctactgaaccagtcatagaaccagttctactgccaacaccacgactggaagctgtacctgttcgtggtatggcagaaacagaccttctattcccgacattaccggttcgaggagcgtatgctccacgagcagtaaaactgtaacttctaggaatataagacgattgctgttgctgctgtccaggatgacccatccggagactgttagctcttgatatatttgtatagcctctttctggataattcaccagggatccagcccttgcactagcagcaaaggccgcatctgcagaaagctcgtggctcttaaggtaattatcaccctgatttacagaattaccaccgctaccattgtaatgatagtcatacctggataagtctggaaccctagtggcttttctcctgtttcctaaattcataccaaataccattgttgaggatttcgatgtatactgttcagtatagcactttgaccagagaagaatagtgatataagccgagcagcgaaaagggtataattaagcttcctcaaatttcgctatttaaaggtatattatatatatgtccgtatttatatacatgcttctttgtttatatcaatgcatcctttattattattctgtgatttatgttccatttttcacttatggaacaatcgaaatttgctatctctgcgaatttatatcgagaaacggttagaaacggctgtacaagaaagcaaggaaaccagggtgtttgcttcgagacagaaaggagtagacgcaatatgggacctgattcaaaatagcagtctgttgcaaaggacattcagacaggtttacgatggacaagtttaccaggtaagggtacgatgttttggtccgttcggaatatgaacgcacacaagatatatatgtatgtatacagtcacgtgattatttataaaccacgtgacacagaccaaatcacatttggggctgtcatcaacgacgtacaaagtgatgaattctctctccaactcactcagctcaattacgcgtgccactggcctcgaaacgtgtgatgttcgtacttgtatcaatgacgacctctctgaggtcgtcatacataactatccaaaactgaattccactcgtaaccgcatttcccccttctctcttggatcaatggagtcacttttttcattccagcatgataatttcaacatcaaaattatataagtatgaaaaaaaagttgatgataatttgaacgaagaactatattccatgtttaacctgaacttgaaatgttataagaatttctgacacgttttgttttcttgcgtgattgcttcaatgcaagagtatattagtatattatatatcttgattaaatttttatgaattattttcttgtactttaatttcaggtatatcctcaacgatcagtagagtcataaaactacaaatataagtaaccagcgatgtcccaagatttgtcccatgttccagaatccatcagaatggtcttgattggcccaccaggtgctggtaagggtacccaggctcctaacttgaccgaaagattctgtgcttgtcatttggctaccggtgacatgttaagatctcaagtcgccaagcaaactccattgggtattgaagccaagaagattatggacgatggtaagttggtctctgacgaaatcatgattaacatgattaaggatgagttgactaacaaccaagactgtaagaagggtttcatcttggacgggttcccaagaaccatcccacaagctgagaaattggatgaaatgttggctcaacaaggtagaccattggaaaaagccgttgaattgaagatcgatgatgaattgttggttagcagaattactggtagattggttcatccagcttctggtagatcttaccacaaggtcttcaaccctccaaagactgaaatgaaggacgatatcaccggtgaagatttggtccaaagatctgatgacaacgtcgaagcattgaagaagagattgacttcttaccacaagcaaaccgaaccaattgtcgatttctacaagaaaactggtatctgggctggtgtcgacgcttcccaacctccaaagaccgtctggtctgatatcttgaagtgtttgggtaagaactaaacttgaatataaatttcactattatttatggtgtttcccattttataacgaatcaggatatgaatcaaaaacaacaaaaaagtagcatagattatgatcagcacctcacccaagatatcgtatcttagcttttttttaccttcttttggtggtgtatagtttatgtaacatcaaaagtacagaatcatttaacgataataccaatagtgttctgttttttaaaatagggaacaaggtaaatgtagtcagagaggcttcacttacgtgcaagaactgacttttttgggggagaataagacaactccagcgaccggaatactcagaagcgagatcgacaatgcattactctatccaactaatacgcctacctcgcaaaagattttaaaaggccagacagccatcactcacgggactaatgcttaaattgaggcggtttatactcacttctacttccagtcttatgttatttcattttccagatcaaaatgtgcataacagtgttcagcggcaggctgggaaatgtcgttgtcgttctgtaaagaaacattgggaaaaaattgcttctagaagaaatacaactacgtcttgttctgtggactttgtaacgtttaatagggttccccgcatttgttttttcgaaattgcagatctgaagcgcagagacagcgtaggatgtgattacgtgacgattatatgcaactggccaccataaagcattctacagtggcagtacaaggttacaaacgaattatataccgggtacttgcaggtgtatttgcctgaaaatctactgcagtatatttaatgtatctagggaacataatcatgctctgccaatgagattatctaagaaaaaactgtccagtgtcactgaacagagagaaatttgatgggactttcctgtgaggatctcagaattgatatgaatagtgtgttcagtgaagtttttgaactcaggaagtaaataatcaactcaggttttacgcctattatactattgtacgcgtcgacattttattgggcaggtttctttcggagttttcatatatatgcttggattaaaaattatccagctcgacctctttgcatcacatcctttattgtttaagtagtcaattaataatggtacacacgtcagtctatgaaagccaggtgattgtgtattacgcttcggcaaaagtgcaatgtcacctcactccacagtagaatttcacgcaaaaggtaaagtattgaaatatcaagcccaaaatacatccatacattcaactttacaccgtcaaatccctcatccctcatctacccaaatctctttgttatatctcacttggtgtccttgtaattactcaattaggcctttttgctgacggacatatatctttcacacttacttaaaaacgaaaatgattcatcttaaaaaaacacgatgattagatacaaaatattcaagaatagagcgcgttaacagcaactggtaacgtctttgatctgaaatccaaggtgaaatacattattaatcttgaatttaattgattgatatttttccagggtcctttgttgctattcagcatcttatttcgacgtaaaaaaacaggggtacttttaaggttatactgacattgataatgtctaagacaggtgctaatctcaaccctaacacctctgttggtatggatttgcgacagtatagtaaattgatacattcgaataataaatgtgatatcaaacaacataaggtaaatttggtgaagaaaccgaggggaagacccaagaaacacgtcgagacgaaattatgcggaccaaaccttgtaccgaatttaaatggttctggtgacttcagagtcaaaattcaggaggaagtttctatcaagcttcgatactgtttcaatacaaaacctacaaactggatgtatttctggtttatttcacacgtcctgccggagttctcatatcagatgtggtatagtatcgtgcaattgaaacatagacaagatcttgttgaactcatgattaatcggtttgagttcttgaaacttattgcaatgcaacaatttgctcagggtagcaaaaacattgacagaacttgggaatctaaacggatttcatatagccatgatcaattggcgtgtttgtttcttgaatcattcaatgccatttcgatggaaaattggaacgacgaaattttaagattacagaataggctgtgggcaaaggttaaggataagtcaataagagattcaagatctgatgacattttatctattcacgataaagtgtttttgttagcagaaacttgtaatcgccagattactcctgccatcgaatggatgatcattacccttgaagatatttatgccatcaataagaattctatgagtaacgattttaaaggaagctcaactgctgctaatatacctattctgactaagaactataactgcaataagaaattttctgccaatgataacgacgtgcgatctacaatcccagtactttccattaacgcgtctgattttcaaacgaatacattgggcatcaatgagcgattgataaagggtatcacagcttgcctgaggggaaatagaggtggaaaaaccgagtcttatgaaaggatacaagttccagtactttacgagttaatgatgcctgagctaccaaagaggaacctgaaacgtctattacaacattctaaagatattttcttaagcaaattacaattgttggataacaacgaactaagcagttacttaacagaagggagtcaagacgtacaattcgagatcagttatcgaaattgtgttctttatcactctttatgtcagtcttcgttcatcgctggaataaaacccgtagtgtcaagtaaagaagaggaaaaagaagaaggtagatcacttgaccacatcaaatttagcctggagcccttcgatgagctgccagaggtgtgtatcgaaactgaaggttttacgccagctagaaagctgtggcatgatagatggatgtcagaattggcaaaatcaaaggtctacttcgtagaaggatttccaaagggggccactgaacatgaacgaaagtattggaacagattagaagaattgcttgttcactattttaaacatttcggtgtcactttcatagggttcagtatcaatgactttgaaactgtcaaattaccacctccatgtttacagactagatatgtcatattcagaagagagggacctttgaagatgaacaaaaacccaaggctatgggactacggcaaggcaataaggttcctccaggatatggggcttgatgtgagttcattgcagaacattttttctcttttacaagacggaactttgagaaagaggaagatcaagagagatggaaaagggcatcgttcttctcaaaaaaggtttaaaagaggtactgtaacggaagagaagctagtatcaccaacattcgactggaacgaatctttggagcaagtgaaattcgcttcctcagcaataactggtactcctcaattggccagaccactggtcacaactggattgaggaaacatgtaaaagaggacagtgtagaactcgatggttcaattgagaaagacacaaattcgttgtcagtatccgggaaactatcggatgcagaactctctgaggataaatcagttattgacggtaacacaaccatatgtggtgctgcaagcctgaaggcaagtagattcgaaccacctcaattcgtagctgaatcttctcaattgtcagatatggtaaagaaacccattgaggagcccgattctttctacacagcgccagaaaccactgattcagatgatgatttagaaaccgaagatatctttcaagaaatatcaagccatgcaaacaaaacctggaactcaactaaaaaccagataccgaaacggtaccatggcataatcagcggaatgcttgattccatcaatgaatttacggtctctaagctaatagaagaaaaccagcaatggtcaaatcttttctcggaaagagatcaattgatccataccttatcttcaaaactgatagagaaagaaaaactcgtagccacctaccagggaaaattgcaacaaatacacgcagaatcctcaacagagaaattgccacaatgacgcgtgtgctaacactatatacactctagctattacaattataatcttgcatcatatctatatataaacataatacacatctttacaatgcgtagatgtaaaaaaaaaagtgtcaatttaatttagacagttaaggtgatgaatcagtacaaaaacataccaagaaaaccggtaaaagtacaagttctaccgtgatgaatgtatgtctataagggcatcttttaatgttgaagagcgagaaatctcaaaaaaaaaaaaattcgaaaaatcaaaaaatcgaaatttgaaaactttgcttagggagaaaccctttgttttatcgaataaaattcattgaccgtgcaaagtagtgggcgacacagtttgaaaacgcaccttataccttatttaccgacaccatagatagttagggtgtggcgctggaacataacttaggtgtaattgtgttttacctagcgcagacgtgtcgagtgttaacagccgctaaggagaatcgttaaaatttgattgatagttttacattttgatttaaaacgccagaaccatttttcttattatcgattgagccacgattaagctcgaagaaaaaataaaattagggttctgcaacaataagctaaactggctgacattaatactgtactcagatttactgtgcgtgcttcctttattaattgtatttggacataagcagtctcattgaagtgtaagtaagggcagttggtttttttggtgatgatgaataaacatgacaagcaacggcatccgtcgcagaaacagaagcataggaataagcaacgacattttcagaaggatcgtttgggcaaaaagatagattctaagaaatctgaggcagataatgatcagataccgattttgtcgtttctgcgacaaaatatggataccaagcaaaatttgacgtcaagaccgggttcaagttcgactccgaccactcctcaggtgtatagacgttccaagactgtcaattccaaaactagtcgctctgaggaaaactccaaggtgcggacttcacaggtacgatccggttgggaccgtcctttttcgtcgcgacagccatcaccttcaccttcacctgccgcttctggatcgcaatatcaaaagcagaaaagctacactaaccggaaaagtagtacttcgcatactgagatgttgaaatctctatacgttggtgatagcaaggtttcatcaccgccacaatcgaatatcgataaagctcctcagaggaaacccttggaaagaacagggttatcgaagcgtgttgtcgaagatgaagtgctgagaagacaacagtccagtttgtcttcatcgggacgtatacacaagcacatagagtctccatttcagagaaattccaaaccggttagcaagagcattgttaaggcaccgaacaaagtcaattttgcatttgaaactagtttgaacgatatagacctgaacctattgacacgcgcaagagcatcgtctggtggtactcccacatcgaaggggtcagcagcggttcctgccgctccgaaaactaaaaataagacggactctcaagtaagtaagatagccaatgagatacaaaattctaataaatcccgaatctctaaggcaaatagtcccattcaaagaacaactactactacatctaacattccgagcgaggctaaagagttatacaacatgctctcatcgcgattgaagagaagaaatgttttattcgacaagaaaggtacaatcaattctgaaaacaatgacaaaactggcgcatcagtaaaagtggaatcttcacatgtcgaaattataggttcaaagcgtgatcacacgcatacaagttttatggagctaccatctatgcaagccactattgcggatttagcaaagaccacttcgcttgtaaaagaaaacagcgcacaaatagaagttgatcgtaatctaattggccctgaacgttccaggaaaaacgaaaaggaattccaagatttggaaacaagaactagctctccggcaaaggaaagtctagcgtctccttctgctgacacgcctgaaagaaaagtgccacaacttgatttgacatcgccatcatttgactccactcctggtgttacagaaaaaatggatctcaaagaagtaccatctcccgagtatccttcatcagctggacaagccgttcaacagtcagaatcatcacaaatatcacacgttatacaacaagcagagggggcggattctggctcacatcacggaattcaagttgaatcaagtgaactgaacatcccaacgatatttgagaagaaagataacccgcaagcagcttctgcttcaggtaccttccatcatgtcgatgaaaaacaatcaactgaggaaaccgcaaaacttttggctttatctgatacttcatctgaaacgtcttccgatggtagttcctcaggccattatgtaggtgatttccaattattgaatacgatgaaggcaagaatggtcggtcctaaggttgcgaaatggaaggcgtttaacaaatctaaatttaaagacttgatgaaatatcttatcgctgaacatacacctcttgcagcaagatcagatgtcagctgctccaatgatatatgcaatataagaaattacgagagcgttgaagttcaccatttacaaaaacttcccccaagattgcggtatcttgaattggaatctccaagtaataatttcatcagtaaacctttgagggccaataacagagttgagaaacttcgtaaagatgagttatacaacggatctaagcaaaaaagaagaacccgcgggtcggcacccgattcagagggaagcaaaaagccactgatagagcgacaaattgaagacggcaatgtatctgagaaaactccccaagaacccactacttctattcctggcgaaacagatgttaatgaaaaagtgttggagcccatcgaagatatcgaaatgttacctacctttatttcttcatccaaccgtttagagccggacgctaatactttatcggctcatgcattaccgtcaagtgttataggcgtcaaaaagcagccttcattgactactgtgaacaaatttccagcttcttttgaaaatggacttcaacctgacaatgctcaagcgtcaactgagatagagacaaatgaaggtaactcaaaaaaaggtaaagatgagttacattttgatcctgaaaaatgtgaagatgtcactcagttcagaaaagaatatctagcattacgagcctcgatatcgaaagacgatacctgttcgtcatctttggtaaatgaagatttaaacaagactgaagttatccagaacttaacctctgaaattattcaatctgagatgaaaattgcttcactcgttggtatcaaccaccaacttcgcgaaaaactagaggaacttgagaagatccaagcaaaattagtccaagaacttgatactgtacttctagaatctaaagggtccttttcggcaggaactgccaaggaggctgaagtgaacaataaagataaaactgaatcgataaataatgagcaggctcgagaaaagtcactaacagctgctcatggaaagctaattagtaaggtagaaaaagaccttgtagaaatagaggcgttgaacaaaaatgtaacagagcgtttgtttgagatcaaacggattaaagatagggaagtagagaatcatcctataataaagcagctcagagacacacttgaaggtgaaagagctcactttgaatcacagttggcacttgaaaagcaaaaggtgtcaaatttaaaggctgctttactgagcagacatggaaaaaatgatatcaatgaagaagttaagccggcagctcctttggacggaaagaaacttgaagaacttcaagcagaactgtctagcactaggttatatgcacgggctcaacataatgctgcaaaacatctccagacagaatgctctacttatcgaaatctattatcagaaaagaaacataagtataatgagttgaattctaaagttgcactagcttcaaaacagtgcgcacaattgcgcagcacgaatgcacatcttcgtaataaactccagagtttagaagacgtggtttcaaaaatatcatctaatacaaaatcaaaattgaaaccgtcaagctatgacagccaaaacacacagcgtagtatttctggtggctcagaagtgcagcaatcatcattgactcctgcgcagtatgaacaaaatgccccaaaaaagctaccaaaatctaacggggcgatcacatatattgatgagaatgaaattttaactaaagacattctaaacgacgaagtaaggaaactgaatatgacagtattagatctacagcgcagaatcaaaacgctaacaaaacttgaaacgaatgtaggccctttgagtgtattttgtgaaaaagaaaagttatcaatacgtgatgtagtggaccgtcttcactggattaagagattagagtcaactattgcaaagatggctaatgaaaaagcggacatgacagctaaagtcaaggatcttgaaacagcgttgagtcagtctaaagaaaaagtggaccgttacgaagaatattcgtcaaaatcccagaaagtcgataaacctcggcctaacggggaggatcccgtcgcactcaaagaaaccatcgttcggttactgaaggaacgcaagaaacttaccgctattttgaagaaccaagctgagtcgaaggaacgtgatccgaattaaagcgtgtcgagataaagaattcccgtaagaagaaaaacaaaatccaaagcacttctatgcaatagatagccgtaatgaaatagcatatgttttctataatgcagttgtaacatttaggaagtatatatatatataaataccatatagcactatattatattcgtacttccatttagaacgaaatttgtagaagaaaatggtacgaaattcatgccgataagccaactagagttcgaatatacaattgatcagcactagctattcatcaactcattgaagcagctcgttaaaaataccaagatctaattgaagattttggaatgatggagatgaggaggtgtttgactgttgacttttagctgcctcataataacaagtggcatggaagaatttgtctcccacctgtacgcagttgctccaaatccattctcccagatcttcatcatatttaccatatgtggattcggtacaaataggacactggaacttcatatctgtggcataatccggtactacaatatatttattcctgagtttagtatagattgcatcagtagaatcttccctgttgttcgcaaatgtaggttgctgttcagcagctccagtatcaatatctgttgcaatgatgtcttcttctttaaagtctgcccattgattttcatccaaataccaattcctggattgaatgaccttggtagatgtagtggtgttggactggatacctttaatcttcttgttgacacggaaatgccaatcaagatgttgtatttccaactccttttcttcaagagtattaccaaatctcttaccacatatactacatttattaggttttgcccgatataagaaatgtaccaacttttccgtaattggatggttatcattaagaacaaactgttgagaaagctgaaggacagatgcgttcaaaatatctaggttttgcgtctggcgttgcgcctctagatcacctagaatatcctgtaaaagtgaatatgacggtagttgcactgtcttggaggaatcaaattcaggttctaatttggcagctaaggtagtaatagatgcttctccaggttcatgcaagagctctttttctctcaacatgttaaccaaactagaaagcttattgagacggttagagttggtcagttggttcaaaaatggagcattaaattgaaggcttcctccgaacatcgagccgttgttaccgttcgcctggagtgagccacgagacatatcattgtttacagaaccttgagatgatggcggcagaaactgagagttattttgtaatggcaactgctgctgctgctgttgttgttgttgctgttgatgttcttgcgcaaaaatctgtttgagctgctgatgaacttgcgacaaaaactccggtgccaaccgttccttctgcaactcttgtctcaactgcttcaatatcgctacttttgcctgcaacttggcgtcatccggtgtacttactagcttcgactgcgtaatcagcgctaatttatcaatatccgacagtaacgatttcacagtaatattcgacccagccggtccgttgtgagcggtatgttgttgtatcgccggcggagtagcacttttctgatgcaacgcactagccttaatcaaaaaattctcgatgctgttcaaagaactatgatcgaacatcaagtctcctgcaggcaatggcaccatccacgttttgaacattgaaatcatcttggttctagtctgattatccacaagtaaataagttttacggaacaatttatgcaaattcttagagaaatagatcgtatacggagaaccagcgttcttacagatagaatccattacatagaaagtgaaaagcttctgactaggaacacatttctccagtctattttcaatcaaacccacaaactcttgtgctaaactcatatgttcctctgctaactgcgtcaaggtagtaattataggccgagagttaaacgtaagaccatccaaagtggtcttaaactcctctaacgcattagaaccatcttcagaactcatagagaaatcccaacaaaactcggaaaaaagtgtaccaaaatatagcaaacaattactattaccacaaactaagcctctggatactagtaagcgctcaaataatgaatcatacggcctctattccttgcctctgctcatcgtctttaaaggtttccttatcctaatcctgcatcttgtaacgttttgctcggttgaaagaaaaaccgaaaacatcaccagatccgggtaacgaaaccacacttttttcttttaaaaaaaacctttcgagatatcgatcaaagattctttcaagaatgaatcatcactgtttttatctatcttgcctttacgtgcatctggctcctttctttctcgtgcgaaactttcaacaacgtttattaagagtagaagcaggaatctcactaggtgaaaagggtctttcttttaatttcttatccatttgaactaagaagagctggaaaaaaagatgactaccaacgataagaaacaatcgggtttggcccgtgtcttaggttcagcttctgctggtatcttggaaattggtgttttccatcctgtggacactatttccaagagattgatgtcaaaccataccaagattgcctcgacctctcaattgaacagtgttattttccgtgactttgcatctgaaccattgggtagacgtttgttgtctttgttccctggtttggggtacgctgctgcctataagatcttgcaacgtgtttacaagtacggtggtcaaccatttgccaatgagtttttgaacaagaacttcaagggtgatttcgatcaagcttttggtgaaaagaccggtaaagccttgagatctgctactgccggttctttgatcggtatcggtgaaattgtgctattgccattggatgtcttgaagatcaagagacaaactaacccagagtctttcaagggtagaggtttcctaaagatcatcaaggatgaagggtttggtttgtaccgtggttggggttggaccgctgccagaaacgctccaggttctttcgctttattcggtggtaacgccttcgccaaggaatatatcttgggtttgaaggattacggtcaagctacttggagtcagaacttcgtctcttcgattgttggtgcttctgcttcattaattgtcagtgcaccattggatgttatcaagaccagaattcaaaatagaaactttgataacccagagagtggtttcaaaattatcaagaacactttgaagaacgaaggtttcactgcattcttcaagggtttgactcctaagctactgaccaccggtccaaagttagtgttctccttcgctctggctcaaactttgattccaatctttgataacttggtctctaagaaataaaccttggattcaaatacaaattcatgtaaataatgttattaattgctactattcaattctttttttctatatgtataagtctcttcaagtcgctggaatgatatccttcatcacgctttgaactatgcaaagctgtttgaacaaaggattcttgtattcttgagccatcttaatggcaaacgtatcaaacctgttgataagttcgtcaaccagttcttcctgagacccgtacatgacactagggtcctctttcgaggattctatcaactgaagatgccagggaaaatatcgttcacatgcagtttgaaccatatcgggagtaatgaacgaggatccagacgtcaaagcgatccatttacaaagcaaagtcatatcactgagtgacctagaatgtgctcctccaccctggctaggtttactaagcctatgcatcctaaggtgaactattaggtctaatatgtaccttcttatcgaatggtgcatatatacagagtccactatggattctgcgaccacggaatcctgccattgacccatatcttcaccacatgcgaaccagaattgatgccttagataagggatcataagtggattatcttgtaacactagtataacaggaacagtggatttgtgcaaccacagagcaaacctattttgcaactcataatcgatttcagcagtaccactatacggtactagataacatgaaatgccattctgcgtttcagtatccggtaagctatcaatactgcatgattgtggggacggtacggcagggttatccatgtgagatagcagatcggatatggactttaaaccttgatcattagaagttccagtgaaacaaaccacatgtcttttcagcaccaaacctgcacgaactccctccgaaatggacacaagagacatggtgaacgtcgagcttgggtcccgaagggaaacaactggctaataacaggtatatcaagtattgccaagtgtgtcgagatgacggtgatgatatattgtgagttttgggaatctatcgagcgttacccgcacacgtacatagtgaaagaaacgaaagtgaaaactttaaagcgatgagatgagatgagataggtttgacacatgacgttcgaagagctgaatagactatcaacggggtcttaattcttcaacagagacacagctcgagtagaaccagaacgcgaacaacacaacaatgggtaacctgcagcactctgtgcagaagaaacagcaccgtgagcggtcgcaagttcaagagagaagcaagtttgggttcttggaaaagcacaaggactatgtaaagcgtgccaaggactaccataataagcaaaccactttgaaagtgttgaagagcaaaacgaaggaacggaacccagatgaattctattttggaatgaactcaaagaaattggggtctgatgggctattgataaccagcaggcacggtggtgaagaatccgatggggtattgaacatggatcaagtgaagcttttgaagacgcaggacagcaattacgtgcgtacgatgaggctagtggagtcgcgtaagagtgagaagaagaaaaactcgatgatgttcacgagcaatgggaaacatactgtttttgtagaggatcaagaagcgatggaatcattcacaccggaagaatatttcaagaccagtacggatatggttgatcgtcgagagaacaggttgagaacggatcaactagagggggtcaaactaggttcgttgcctggaaaagcacaaaacgaggaatcgctacgcaagaagaagttgaagaaatacaaggcgatcacgagacacatggaaagagagagccagcttgctgcggtagaggaacgaatgaatttacaaagagaagtgatgaaatcggggtccaagaagaagattgaagtgaacgggaaggtaacgtacaagtggaagaaacagagaaagaggtgagcatgcctgccacatcacgtgacaaagtcacgtgatgtcatcctttatttagacacacataagagaccgagacagaagaggtatgtacaatagatatcagagcctcttggtgtcacgtgtgcgtgacaccaagatcctccaccgaccaataacagatgacttagtcaacttgaggtaaaaaaaaaaagagctaaatgacaaacggcccatttcaaccccaagtcgcctccgattaactactggcagggcttgaccttgcaattgctatataagtggaacaaccgttaaacaggtttactcctattcaactgtttaacctttaatctacagataattggagaactgtacctactataagggtcagagtggagtaagtatataaaatgagagaatgacttcgaattaagggatagagattgaatcgatatatatatgtaagactgtgtcgataagatctatcaacggctactaatagaagttcaacacccagaaattgattgttttggcctgaaatgttaatggcagggaatcaagtatgaagtatgaagtatgaagtgtgaagtgtgaatcccgtaaaatcggagaaacatgtggtcacctggtcaaggacttaagggaacacagcggttgttctcggcattaagcggtactattgtcactttgtaatggcagtccgaatcacgttttattatatggggggggggaaggaacgacggtacataagaatgaggggcttggttgcggtgtacgggtttagtacccctctcgtccgtgcaagcccaaagacaagtttttgtttctttttcgtatccatccccagaacagtgcgcagcaaggaaatattccgtcatgcgtttggatggtttttcccctattgaggggcaagtgaggggtaaacgaacggcgcctgaaattttcccgctcaatgatatgaataatcagtaggatctccgagtttcgcaagaagcagtaagcaactccgttttattgcgagacaacactattgtgagaaaaggcactcaaaaagcgacctccgttaattgatgtcaactggcatcaatttgagatactttgggtcaatttgcagtgtgcattcgcattctttgtgttaaaatccttttccccagaagtcggagtttacaggacacagggtgtggagcaattgggagagctccagcagggctggagctctgcctctgcctctgccccaggtccaggtccaagtccaagtccaggtccagcgagaaccggagtgagaggtgtgtgctgtgccttccactaaacgaaccagtatcccaggtctcttaagtttcccaaatctcggcatggtcaggcctctccactgtagcagccgcagcacattttttttttttttctctcttctaatggatcaagcatcactacttatcacaatttatcactttttccaatgatgttgccattgcccttgttggccttctcgaactagtccgtctttctggtttaacttggtgagggaaattcttagcactggactgcgctgtgatatgacctgttaaattataaaaaggagtcgtttttcaattgacaattttttatcattgtctctgggatcaattggtttttcttcctctctttcgcttttctcccccaccaacaacacaacatacaacacacgcaatgttcagattagcccgtgcccaaactgctctagcgaacaaagcttctgtttccagaagctttttgagattaaactcttctttcgctatcccagaaactcaaaagggtgttatcttctacgaaaatggtggtaagttggaatacaaggatttgccagttccaaagccaaaggctaacgaaattttgattaacgttaagtactccggtgtttgtcacaccgatttgcacgcctggaagggtgactggccattgccagttaaattgccattagtcggtggtcacgaaggtgctggtatcgttgttgccaagggtgaaaacgttaagaacttcgaaattggtgattacgctggtatcaagtggttgaacggttcttgtatgtcttgtgaattgtgtgaacaaggttacgaatctaactgtttgcaagctgacttgtctggttacacccatgacggttctttccaacaatacgctaccgctgatgccgttcaagctgctcaaattccaaagggtaccgatttggctgaaatcgccccaatcttgtgtgccggtgttaccgtttacaaggctttgaagaccgctgacttgaaaccaggccaatgggttgctatctccggtgctgccggtggtttaggttcccttgctgtgcaatacgccaaggccatgggtttgagagtcctaggtattgacggtggtgatggtaaggaagaattgttcaagcaatgtggtggtgaagtcttcatcgacttcagaaagtctaaggacatggtcgccgatatccaagaagctaccaacggtggtcctcacggtgtcattaacgtctccgtctccgaggctgctatctccatgtctaccgaatacgttagaccaaccggtgttgttgtcttggtcggtttgccagctgacgcttacgtcaagtccgaagtcttctcccacgtcgttaagtccatctccatcaagggttcttacgtcggtaacagagctgacaccagagaagccaccgacttcttcaccagaggtttggtcaagtctccaatcaagatcatcggtctatctgaattgccagaagcttatgaactaatggaacaaggtaagatcttgggtagattcgtcgttgacacttacaaataatcggattaattaaagaatgtgtccctcattagatttcttttctttatttaactcccattattacaaaaaaaattagtgcaagggaagagtctctcacctcttaacttaaaatgaaaaagaacaaacgtattcgccataatcatatcatcctcagcctcctattttaacaaactcacacaacgattcgctctggctttatgaaccttgccaggcgtgtgtttttaagaagaagtttaaccgttagataagaaaggatgaaaatttgacgatacgttcttattccatgccaccccccccccccactgttacgtatgtttattgttagagcttatgacctatcgatgactattgttattatcttatacagatgaaaaatctcttttatttgaattgatttcaaacaacgtattttttatatatcatagtagtcattgacccccctctctttcttatcaatgaagtaaataatattcaatcaatattccaatttttaaactaactttaataccagacttatctttgaattgactggtattgtcactactagcattaatttatgtgtattttttaagatatatatatattattctattgttacaaagttttacagatatttttattcttcttgtgcactaattgcaccggcaacgtctttattgaaccgttcaaatgatgccatagtatccttatcgttaacgaacctcttactgcgagtctccagacttagcactgtctccgtaccattcatgcatctcatctcaacggtaaatttactcttgggtcgatttctcttaataccaccgaaattgcaatcgtacgtcacgtactctttatctcccttacgttccatcttttttaactcacaatctacaccattcttaccgaattgcgtcatgagtaagatgtgaatgttatcaaacggtatacttgaggtccggtattcatatactgtccgctttggtttcgaggttttaatccgttgtaatagtttactgaaccaattaacgggggaggaagacttcatactggtaattggtttcacttcatcctctttgatctttggtaatttgtttatgtagttggatttccttttgctgccaacgttatttgtcgtcgtactgttggcatttagcgtcggttgtcttctttctgcggcaacgggtttgaagacctgttcggattcagaacttccgtcatcaaatagtaaagtcacccttctagtctgaccttgaccatggtttccatcatcgttcttttgttcttctgttgataggtccaggttatcgccattgatagaagatacaagaacagtggaatttcttttaacggtagtgccgtttgtgtcttcattggtttcattttcgactggacgtgtatctaatgcacttcctaggagtcccagtccattatcgtcatattcagcacggctttcatcaccgtcgagatctttgaacatcgagatcatagaaccggtgatggttaaatctctgtcaccattcgaaaatcgcttttgtttgatatctttgatgggactcaatttgaacttagatataatttgttctgtcgtttcccttggtaaattatccagcttatccatttgattgatgtataaactgactcttacatccgttgctggtgtcaggacatgacttgtatcgattgaatcgatagaagcagcttttttcttcaagttaagctgtgactgatcgatcattgactcagaagtagtaacagattcattagcatcgtctggagcgtcttcgaaaatatcgatgtcaccggctgttgtgaccgctggtgcagtattgacgttataatcgtcataattggaactggtctcaaaccggttcgaatcattttcaatcatcaaagtttgattttccgagagtttttcatgatcagtattaacaggattagatgcctgagtaactggtactttatcctcatcgatattcatgataaactgagagagatctttgaatgtcattgacgaattgatcaacgacgatggcatgcgtaagagatcaggcttaatgtcagtcataggtgtactggtagttaacacggtttccggtgctgtcaacttacttggattagtcttctgcctttgcaattgattttcaccttccgaagaacctttcccaccaaacaaagcctgcgcctctccgcttacagtccaatccccactatctcttagctttctaatggtagatcttgacttgattctctgtggaacactgaccttccttagaaggttctcaagtgatggcttaggtttgttacgtttggggtccaaagatgagacatacatggacttggattggaatgtattggtcatatccttcaacggagtcatagaaacaggaacagtcgctattgtgttatcagccgtcttccgtttcattgatgtcacactttgtctattttctgtctgtggctgattgttcagttttggttgtgccagtatattcttcgatggctgcgtaagtttttcattctgttgagctttcatgtgctgaccagattcaccgaggaaattatccatcgttgcaccatgcacagacgtacttctatcataatcgtccacaatagattcaagtttggatgaagtgtgctccgaggatgaaatagaaggtaaaggcggaggtggatattcatgttgcaactcgtcatgaagcaattcgttcaagtttattgaacgtttagaaatagattgcaaagagtacaacgatctctttgaagctgagttttgtaacgttcttttctttggagtggtaggagtcaatgacttcttagagctggattttgatatcgattgtgaggaagattttgcgccaaagtttggttggaaaagttttgaggaggaggaagaagcaatgaatccctgttttgtcttctttggagattttgaacttccatttttcaaggaacttatcgagaaatgtgatttctggtggatctttggagcctgtagggtactagattcagaactatcagatgatatttgttgtccaaaggccgatattgttggagccatcgatgctggcagtacagttccgttacttgattgttgttgttttttcgctgtatttgttacactattcacatcagatgaaatattcaatggactgaccgaggaagcggacgatgttttcaacgtaggaacaggtattaaatccttttgcatcgatttctgttgtttctcctgataattccatagtaaagaataaaacattttctcttcagtgaatcctggtttcataagtcttgtcaccaaatgtttccttgcagcaccgtgccataggatctgtaggttggataagattgtctcatcgatgtccctttccgacgaaaagctcacaatatttggagtacgattcaacagattcaaatccgaattagacttactgcgagatttctgatcatatttcgtcagcaactcatgctgtaagatttggtcaatagtaattcttctatttggatctaccaccaggattctagaaattaaatctttagcctctaccgataaccattggggcatctgatattttcctgactgtactttcaacaacaatttcttgacgttatcgtcgttaaagggtaaatgtccagtcaacagggcgaacaagatgataccacaggaccaaacatcacttggggatccatgatatttccgacccagaacgatttcaggagaagcataatgtggtgagccacacgaggtctccagcagtttatccgaagtctctagggcagccatcccaaagtctgcaatcttgatagatctctttttcttatccaaaagcaaattctctggtttcaaatcacgatgacaaatattgaacccatggcagtatgctacagcttgtactatctgtttgaaataatggatagcctcactttccggcaacttccccttcgagaccaaatagtcgaacaattcaccaccttcaacatattccaataccaaatataactcagatttgttttcccatacctcgtagagacccatcacattggggtgcgagataagcttcataatgataatctcacgttcgatcccatatggcagctgtttgatctggttcgacttaacgaattttttgggaactatcttaatcgctgacagtttccccgtttccatattctttgctagacgaactcgacccgatgaccctttccccaaagtcttacccaatttccagggacctaccgtatcgcggtttctcctcttcgaagtcttggtattattaacattagcattcgacgatgcagtcgaaatctgtgaaagacgcttagtagcgtctgttactgactgaacaaccctattcaaatgttcattatttgcacgatatgggacctggccgtgactagaattatccttcattgccacaacggcagcttgaacagcacacgacatctagcacaaacaaagcaagcgagtgaaattgagaaagcaaaagagcagaagagagcgtgtgtgagtgtttaagtatgataagcgaatgtaatgattggaaaataaacacactctgtgatcaaatcaatgattcttcttcttcttattattattagtattcttcttcttccttataattcaaatggtagacctagccttgtaatttgcagttccagcagagcgacaaatcagcgttactgatgatgttaacgttgcttggtgtcttctctcttggatgttgtttggtttcaaattctgattcaaacattgttatgtgtgcatatatttcatgaaagggctttatttggtaaatagttgaagtcattctgcacgactagtaaatactagcaagacgcgagtttgagctttgttcgcgaagacgaagacgcgaaaacgcgaaaattggcagaagcagtaaagtcgagaacatggcaagttcaacttgctgtgatagatttgaaccagggctttcggcgctggttcaataattgtgttggttgctgccagtgtgctggcacgggcacgggcatcagcacttttggtttatctgaatgaaatataggcacaaccacgtgacctttgaatttacacggccgaaaacaactagatattgtcacgtgacctttatcaattctgttgcctatacgaactatgacttaaacttatccatgatatcttatagcaaccatctcgcaccactctcccctgagaatagtaactaattgatcttcaacaacgcttaataacgttactatccctcgatattcacactccgctcccaattcaagtcatatttcgctcgctgtacaggactctgaattacttttaacgtctatcgatcacagtttcttcttctcccctatattaaagataaagacactgataacataacagcgctcaaagagacaaacaccatccgaaaagtgcaacccaatgacagaacacatcgaaataagcaaagaaactatcaacgctctaagcgacgtcttgaaacaactagccgtcattgaacctaggtcaagagacgttaacaaccaaaatgacaaggttaccaagaagtcgactagtaagcaaagccaattctcgaacaaagcgacgttcagagagtactcgcaagagtacatagatttcacatatgaaaaccctaccatttaccacgtcgtcaagtattttgccaagaaattggaagagaatggcttcggttatctcagtgaaaagagttcttggtccaacgttgaaccgggccattactatacgaccagaaatggtacaaacctctgtgcctttgcggtgggacccgaatggaaacctgagttaggtgttggtatcattggtgcccatattgacgccttaactgcgaagttgaaaccttcttctaagaaacctgatgtggaaggattcgaattgttaggtgtagctccatacggtggtactttaaatgaactgtggttagacagagaccttgggatcggtggtcgtgtcctaattaaggaccctgatactggtaagatcagttcgcatttgtgcaactcggctccacaccctatcgctaggattccatctttggcaccacatttcggtgcaccaagtgttggtccattcgataaggaggaccaaactgtgcccgtgattggctacgtcggtaatggagactacgatgatgatgatgaggaccacgacgtcgaggatgaaaagaagagcccgttgtacggcaaacatagtatccatttattgagatacattgccaagttactatccgttaaagtgtctgccattacgcaatttgacttggacttattcgatgtgcaaaagggtactttcggcggtcttaaagacgaattcatctttgttcctcgtattgacgacagaatctgctcgttcagtgccatcaatgggttgatagagcacaagaagactggccataaaaaggatggatttaacgtcgcagtgctttatgacgacgaagaagttggatcgttgacaagacaaggtgctaaaggtggattgttagaatcagtggtcgaaagaatcgttgctagcaggggaaacgacgtctctgagacgcgtacggcattcgccaactctatcatcatctctgcagacgtcacacacatgttaaacccaaacttcaactcagtatatttagagaaccataaaccaaagccaaacgttgggatcacccttgcattggattccaacgctcatatggctacagacgttgttgggaccgcattggtggaagaattgggtagattgaacggggacaagatccaatacttccaaatcaagaacaattccagatctggaggcaccattggtccttctttagcatcccaaacaggtgctagaaccattgatatgggtattgctcaatggtcaatgcatagcattagagctacaactggtagtaaagatatcggcttggcagttaaattctttaacggattctacaacgactggaaccaagtctaccaatcctttggtgatttgtgattaaaatcataactcacctccatttctataaacccctactacggttactaatcttactgaaatatgatcgtcctaatgaattgggcccacatgtctgaatttgaactatgaatcttatacgcaaagacatgcaattcatacctcatcatagtactacataacaaaactataccagttacaccagatacaggatggccctacgaattacaacctccatcaggacaactcaaacctctggtcctttggtcttctctgtttcaagcctttatggatcacactgtatttacatttctaaaactggtaattatagtaacaaaaaaatttttgtgttatataaataaagaacacatatggtataaatataaactggacttattcactcagggttttatgccaagcgttcgaaaggaaagaagctaacaaaggatccagtaactctaaagtgttccagcggtagcattagaaaagacgctgaggcaagatagtttaggaacgcgatagaatgtgtggtatctttggttattgtaattttttagttgagaaatctcgtggcgagatcatcgatactttagtggaaggtttgcagagattagagtacagagggtatgactctactggtattgctattgatggtgacagagaagacgaaactgttatttacaagcaaatcggtaaagtttctgctttgaagaaagagatcgaagctcataagccaaacagggacgcgcattttgtcactcattgtggtattgctcataccagatgggctacacacggtgagccaaaacaggtgaattgtcatcctcacagatctgatccaagcggtacttttgttgtggttcacaacggtatcatcaccaattttagagatttgagacagcttttgacgaataaagggtacaagtttgaatccgataccgatactgaatgtattgccaagttattcaagcatatctacgacacaaatttgaagaacggtcatgatccagatttccatgagttaacgatgcaagttttgcaagagttggaaggttcttacggtcttttgtgtaagtctactcattatccaaatgaaatcatcgccacaagaaagggttccccattgttgatcggtgttaaatctgaaaagaaattgaaggttgatttcgtcgacgttgaattcccagattctgagcagttaccagatttgccagttaacaacgaatgtaacttgttgaacgatgctgatagaagtttgcttccattggccggtgacgaaagtaccttgcgtagatctcaatcaagagctttcttatcagaagacggttctccatctccaatcgaatttttcctttccagtgatgctgcctccattgtaaaacacaccaagaaggtcttgttcttggaagacgatgatattgctcacatctacgacggtgaattgcacatccatagagctaacaaaaaattgacagaatctgccaccagatccattcaaacccttgagatggaattggctcaaattatgaagggtccataccaacatttcatgcaaaaggaaatttatgaacaaccagaatctactttgaacaccatgagaggtagaatagattttgaacacaatctggtcaacttgggtggtctaaagtctagattgtctgccatcaggaaagctcgtagattaataatgatcgcctgtggtacttcttatcactcttgtttagctacaagagccattttcgaagagctaacggagattccagtatcagtggaattagcgtcagatttcttggatagaaaatgcccaatctttagagacgatgtttgtatttttgtttcccaatccggtgaaactgctgacaccatgttgtccttgaattactgtttggaaagaggtgcattgaccttgggtatcgtgaacagtgttggttcttccatttctagaagtactcactgcggtgtccacatcaatgctggtccagaaatcggtgttgcatcaacaaaagcttatacatcacaatatattgcattagtaatggtggctctttctctatcagacgatagagtctccaagatcgaaagaagaaacgagatcatccaaggtttgaaattgattccaggtcaaatcaaagaagtcttgaacgtggaaccaaggatcaaagaactttgtgctaaagaattgaaggatcagaaatctttacttctattaggtagaggttaccaattcgcaagtgccttggaaggtgcattgaagatcaaagaaatctcttacatgcattcagaaggtgtgcttgctggtgaattgaaacacggtgttctagcattagtcgacgaagatttaccaatcatcgctttcggtaccagagattccctattcccaaaggtcctttcctcaatcgaacaagtgatagccagaaagggtcatccaatcattatctgcaacgaaaacgatgaagtttggcaaaacaaggccaaggccaacaatttgattactttggaagttccacaaactgtcgactgtctacaaggtctattgaacattatcccattacaattgacctcatattggttggcagtcaacaacggtatcgacgtcgatttcccaagaaacttggctaaatccgtgactgtcgagtaagaaaggctctatctttttctcattttgcgtacagtttatctaatttttctagtttgtccgatacattctccacatatataattaacaaacccgtcagatcaattccgttcccctcctacctactattaacattgtaacaccaatggtaaccctcttgtctcttgttttcatacctttaggtccgatttggtcttatttcggtttcttttcgaatgattgataccttgagataaaaacagaaaaaaaaaaagggcaaaacattcaaatcgaactttaagtgccgaacatcaacagaaataacgaaagcaaaggcacgtaaaataccattactgtttgttagagggcactagaacaggtgtaattcgtgtatcagtcagctgaaagtatatattaagtggaattggttcaagagagggattaaagaagctgctgttgcttttataaaaaaaatgtttcgttctagaaagtcaagagaatcgcgttctattgatcctggtgctttggttgctgcaaacaccattgggaaggcactggtaccttctaaggattcgtttgggggccaggttgtagataagagtaagattcccaggtataacagtataagtggccgttcctactcgatggtaaacagtcccaaaccaagttctcgtcggaactctgtgagacatgctagtgatactggagatcgttcttccaggtatggctcgatgcgttccgtacagagtggtaacagggttgctcaaagcgatgcagacaaggttttccatgagtttggtggtaatgaggccaaatatgtgctaggacccagtggtctggtacgtgttgataatgacaataatgagcctaaaatggtatctagatacattcctagcagccatgggttggtcaaagtcgaagttcctttggaacagtacgaggctgagaggagaaacagtcttagaaggtcgacttctttacgtggtgggatgactgtaagaaactcactttctaataaaaggagtcatgcctctttaagagcaaactcaattggacatagaacaccttctggaaccccattgaaaaaacttacagaagttcctaccgttgaagaaaaaaaagcggatattactcattataggtcttcgccatcaccggtgcctagaatcacaaagactgtctatgcaactacagccaaagaaacatcagctccagtcgaagaattcaaacccccatccttcggtaacggtactgcattaccacagactcctgaaagagctatcactaaagatttgatagactcagcgacagaagaagaacagccaaaaattcatactgatctaagcgttaccaaagaagctgttgaacaaaagatcgaccttgattcaaagcaagtggtagaagaagaacacgttattcttacacatcagaaggaagttacttctttgccagatgaaacgattaatgccgagaaggaaactgacaaggaatctctcaaaaaagcagagcataacacatctaaagtagatattccggattcaaaagaaaaggctcttcctggcaacgatggtgtccaggaaactatagttgaaaaagtggttgatgaagaggaacatcaaattgaagttcaagatcctatcgttgctgaacgtcaatcagaatctcaaccggagtcccaaccggagtcccaaccggagacaggcaaaagcaccctcgctcagtatatcaggtccgctaatccagaactccagagagttaatgaggaggatgctcttgttacccctaagattccattagaaaagactccttcacctataaaatccgcaatgaagaaaacaaaccacaacagccaacaacttcaacaacaatctcaagcttcaagcgcatatctgtctttaacaacaaaggaaaacactaggttaaatgcgcaactttctcacgaaagtttgagagaaaccgccagcaaacaacaagcacaaaatcaataccgaagacagcaacagcaaaaccagcagcctctagctcctaagagaaattctcaaagaccgcaatcaatgatggctcaaagagttaatggtgatagacgttctttcatgcagaataattccggtgttgcttcccctcgcgatgctagacctagaagtgtcgtagggaagccgtccaacaatgccaaatcgcaacaaaatagtggactttacccaagggaacctcctcaaaagcgttcaagcttcgaaaagcaaagaccgatgtccaccaaccttggatttaaaaacttatcgttgagagaggatccgcaactcactgaccagtacgagcagcctcaagccccattccaaccacatccacaacaaagacaatctagaaactcaacccctgttaaaagtggagtaacgtacaatggtgtacagtatgtctccggatcagtaccactgcctgcttccaataccaacaataacaaaccaaaagcgtcgtcaattgctcatggattcaaatcaagatttgccgactctgattcggacgaagaatccgcaaacctacagttcagcaaccaagggagtcgatctactcaagtttcaagcgaatatgaaccggcacctcctccacccgcgccatacaatcctcatgctactttgagacctcagccagagcctcaaataaacgcaactcacactactgagaagaaaaagaagaacaacttcagcagtaaactaaagaagcttttcggtaacaagaaacactgaaaagtagcgactaatataacacgaaacacatgtaatgggcatttataatcccttttgtattctagttacccaaaaattgtgattaagaacactaaaaactatctaatgtacaattcaaaccgaagctttgtagtaataaataaataaataaataaagtgaaattaattaaagtcaatttgatgatattgaaacatcttgatgtgattattgaaccacttggcgcaaagaatcgcataaataatcaatattaccgtcgttaactccagataacgacatcctgccgtcttcagttaaataaataccgtacctctcctgcagaatttgaacctgatatgggtttaaccctgtgtaataaaacatcccatgttgtgttttaaaatcaacaagattgggccaattcaatctctcatgcatttgaattctaacgttccatagtctatcagacatattcttaacgtctacgaaccattgctgcttcaattttggattgcttagcaccaagttcgctacacgagacccatatcccggtggagaagagtatatacctcttacaatcttctttagttgagagtcgatggttgatttgagatccaagggatttggtgggacaacgacacttaacgaacctacacgttcaccgtataagcccatgttcttagcaaacgattggcacacaaatagaccgttgggccattcgtattctagacacattcttaatagataagcatcctgtataaggttccctgattccattccttggtacgccatgtctattatgggagttattcctaaatcatggatcactggcaatatctgttgccattgttccaacgtagggtccactcctgttggattatgacagcaagcgtgtaacactatagaggggggccagtcggggtccctagaactacaactctccttgagttccttgagccatttatcgatactcaatttcccatcctcgtagtacgtataatatttgatctgattgaatccgttccattggaaaacgttcgaatgattagcccaagatggatttggtatccatacggttttcgacacaaacgttgccaagagttttgaagctacagctaatgcaccggtaccactcaaagtttgcacaaacgtgattctgttgttctccaataattcactcccgtcacttgactctcgatacaagaaatttaacacattgttttggtaatcctgcgacccagtgataggcaaatacgataaatcattattcagatcgagactcgtctcaagtaatgattgggcagaagctacactagggaaggtggtcacacggccccggttgtccttatagatcccaacggtcagatttatcttgtttggatgtctgtcaacgttaaacttctctgttaaacctagaatcttatcagcaggagccctagttactcttgacaaggccgacagccctcttcgcgttggtattctcattcaaattggggattagaccttaatttcttgttaatagtactattgcaaatataaaaagtgcgttaattcttcaacactccactaattccctgttaataatacaaaaataatattcagaatggttccataaaacaacaattgatgtgccgactcttatagtcctaatgtatgctggattttgaaaggttattcctttgttcaattattggagaagttaacgatctataaattatccgatgagatgagagttgtcattaagtttacttttctttttgatttatggaaaaagtgaaaaatttcggataatttaatgacgaattggcttggaatagtgtctcaaagggccaataggtaccatcttctatcatttttgcggtacaaatcattcagaatcaaatactgagtggtttaagagtgtttaaacggggaaaattggtttagtttggaggatttaagatcaaataaaacccgagaattttttttttttttaaggtacaattgatgaaggtgcttttgattgacatcaatgctcgagtgataaaccattgggccaagggtttagggaatctacttaaatctggcgaggtttccatacataatgggtcgttagagtcgttcgaaccgaatgggctgttaaaatcaatagtgtcaccgggaaattcttttgggtttcttggtggtggatttgacctagcgatacaggaatacttcggtggctcgttgtttgagcgttatgttagatataagttgatgcattcgtatgttcctgtgacgaattgcactgtgattcccttgaatcagtttagtagagaccaattccagtaccttttacatataccaactgttgtgacaccggtggttccagattacgaccgtcgagatccagtccattccgggtatagaatcgtatttgacgttacgtggaatgcgttacacttccctccaagtgaaacagaacaactggttttaccgggactatgtacaggttacgcaggcgtaccgatccctatcgcatgtaaagccatgtgcttcgccattagattgttctacctgaagagcatactgtcgcaagaccttatcaacaccatgatcatgtgcttcatgggataccagtacgagccatttattagtgaggattgtctcatggaatgccagaaagtaggtatcgactgggatacaatgcaccgtttcaatcctcatgaagatcctttggattcgatcttaccatctggttactgacgcaagatacatgaaatatacctgtgaataagaatcatttcgttaaaattacacaacttgtttatgtctataaagtggaatttgactctttcaacttgaatcggatgagtcgtctttcgtttctgtaacttctttatcgcaggaaatgaatagcttgaatgcgatgatcaatgcgagtatgctaactgcaaatgtaggaatgtaggagatcaaaaaggattcgttgtagatttctaacaaatcacgcaatatctttccactaaaatgatttcttaggaaactagtatcgtgaattagtgactcgtactctttatccatgttaatcggatgcaaatattggtataacttagtggttgccgaagattcaaaaatagtgagaacagaactggctccaagaacagtaccaatagatctccataagtagaaacagccggtgatagtggcctgttgagatttgggaatagtgaatacaatactaaccaacgttgctaccaagagtgatgcgtaaccccaactgttcaagatcattgctataacgtaaaggactctccacctgaactgatttgaagtgaaccagtaattggtaccactagtgtctaaagcgctgacatgggatgtagggttcggttccaggtgtgatatggtagtataacccaatgaaagggaaatgaaatgtagacagacagcaatggtaatcaacagatatgaacaagtagctagacctaggctcgtatttctcaagatccacccagtagctagacttgcaagggcacttgatatgctggaaaacaataggaacccaccggtgctggtaggagaaatgttttggactaattgaaggtatacgggattcctaaacacatcaccgaacgcaataaaggaggaaaagaccgttagtaacgaggttattccgaacgttcctgaaagtagatcggtagggatgatacgttcaggggcccagtataattcgttcataataaataatacaagtgaaagcagtgtcagtgttgctaacaatggtttattaaggtccgtagaacatagacataagaaccctgatatcgtaccaatcaaagagatcgagcctccaagatcaatccgttttatgttttcccatctatagcgttcatgtcttggtggaacgtgcaacaacttgatattcacgtttctgtatccaaggaacatacaagtcatgatcaatggaacctgtccagcaaatataaccttccacccaaaagaatccatgagccaaccaccaatagggccacctaacattgaccctgtaccaaatacaacattcgcatatccctggtacacgcctctctcctttggggtacaaatatcgcttacactgatgctactgagtgcactgatacctcctgctcccataccgcatactgctctggcaatggaaaattcgaccaaattacgagaaagagctgtgaacagacatccgacaaggaagaacgaatgagctaccattaatgccgtttttctacctgctaaatccgacagcttaccatacaacggctggaaagcagtattagtcaataagaaacttgtcacaatccattgcttcttgtcagattcttcaaattcttcagcaactttgttcataatattagcaacaatggtggagtctaacgatcccaagaaactacccatccatagtgaataaagaatcggtcctttaggcaatgctaagttatgcctatgatacatttcttcaagatcatcctcatcggccgatgatgacgttatacggttgcttaataaccgagtggtttcatcagttgaatggttcatctctgctcgcctgtgtataacgtgagttacttgtcattagagattctccggtataaccacagcaatactaaccatccatccaaatggtacgttgcaggttatctttgttgatcttcttcctcatcaaccttatatactttcaatgtgtcgctttatctatctcggatttgtttttgccaaactcggaaagatcacaccgagaggcatataggcatgcataatgttaaacaatcaataatcagtacgctctagactgattaatggccaagacaacaagcacatcaaacgtaagtgaagtaaattgtgtcaacgtagacctcttttgttattattaagaatgacttacttaaaaccacctatttacatgcttgatatatacagtatagtctgatgataactactggtgcttgggattacgaaatgaaattgcagaaacagagtagttagagctaataatgttattgtttttaaaagacgttgggatcatcttgttcattgctctttttgtctgaatccttcttgtccgaatccttcttatcattatcctcctgttcatctttcttttcagatgctctgttcttcagttcgttagctgcttcttgatctttgatctttttggtttcacgttcattcaagtatttgtcgaatgcgtcgttacgttctgggaattgacgtttacctaagagtgcaatcatatcttctcttgttagaacttcctttttcagtagaagttgagcaatcttttcaacgtcttcagccttttctttgagtaacttggcgcaacgatcgtggcattcttgaacgatacggtacacttcagagtccacaatggatcctgtttcttcggagaacggtttggttagatcgttttcacttttcttggcaaagttgatccacccgatcttatcgctcatacctaactcagttaccattgcagtagccatacgagtaactttcttgaaatcatcgctagcgccagaggtcacgcttgggaagtgcagttcctctgatacacggccacctagtgccatggtcattctgtcctttagttgttgttctgaaagtaggtatacatcacctggtaagtattgtgcgtaacctagagcaccttgacccctaggaatgatactgactttgagtaatgggtcagcaaactctagataccaaccacagacggcatgaccagcttcatgatatgcgacaaccttcttttcttgtggagacaatagttttgattttctttcgacaccaccgatgaccctttcaatggcctgttcgaaatgttccaatctaacagcatcacaatcgtttctggcagcaatcaatgcagcttcgttacaaacattagcaatgtcagcaccggagaaacctggtgtcataacagccaatctgttttgtagatctgtcatatcaccagccaatgtaattttcttcaagtgaactttgaaaatttcttgacggccttgtaactctggtctatcaatgttgatatgtctatcaaatctaccaggtctcatcaaagcctgatctagaacatctggcctattggtacctgcaaggacaacaacatgatctgcagtagtaaatccgtccatctcaaccaaaagttggttcaaagtgttttctctttcgtcattggcaccagagaagttacccttttgtcttgccttaccgatagcgtcgatttcatcaacaaagataatagctggagcattttctctagcggtcttgaacaaatcacggactctggacgcaccaacaccgacaaacatttctacgaattcggaaccagacacagaatagaatggaacaccagcttcaccagcagtagcctttgctagcaaagtcttaccagtaccgggaggaccagataggattgcacctcttggaatcttggcacccattctttcgtatctggatggttctttcaagaaactaacgaattccatgatttcttccttggcttcatcgcaaccagcaacatccttgaaattgacctttacgtcggtatctttattaaactttctggcctttgatttacgcacgttgaataaaccacctgggccaccaccggcagcggatgcaccctttgtagtaatccaaatcaaacctgcaatcaatagtgcagttggtaatatttggaaagctaatttgacccaattcccctctctagtgtaaagaacaggaattctaaagtcttccgcgatattcaattcatcttgtgctttcttcaatttatgttcaaatgattccacggatccgatcgtaaagaaataaaaatcgtggcccatatgttcaggttgatttttcccgttatcgttcaagataaccttgactagattattattgataacaattaatttggacacgtaccctttcaccaacaactggttacggaattcttgccatgtaagttctctttgttcctccatgctgttcaatctgtgtaggataaatgctaatatcgtcaatgtcaaaccaactttgaataaattgatgttaacagtcatcatattcgaatcatttggtgtgaaatccgtatttccgttggaactcttcttagactcattcttgggatcattcttgggatcatgcttcttcgccgattcttcaaattctctcttctcgcgctctagatggaaaggatcattcgctttatcttgggcatcttctttttcctgctgcctcttcacagcaagctccaacctctgtaattgctcttcaatcttcttcttacgctcttccatatcgagtttctgatctttgttcaaatcatcgataaactttctaacttctttcctgactttatcaacgtcttcatccgtaggctccttttcaaaccgattctgcatcaagttgagcttaccggaatggaacgtacggcatacgtcgtttcgtaacaatatcagcgaacgcccctttggaactttgtacaacgccctactggccacagactttacgccaagcctagataccggccttattaaatggaacattgcaagtcacttcaatgtaataaaaccaccacgtcgctgctacggttagccgagtctgattgctataccgtttacctaacaggacttttcgaatttaaaaccagtggaaaatctttgttaacaccgaaacaaaccgagacaaaaacagccgtttcaacaaacacctggctattttacactactatagggtcttaaattcacaatgcaaccactgtagattgcaaatgtaactgctaacgctccttttatcggtggcaaatggccttgtctgttcaccttatggggttgttctggttgaaaagcccaaattcatttttggtagagcaaggacatatcgttacccggccacttagtataatacactcttattacgtatgttgagatatacacgtatacatgggaggtcagttcagctatgttataggcttgtttcgaatctcttttgttcttctatagcagcgactatatcttcgtccaagatgtcttcgtacatcgatgtagggacgtcagaaagaccggtgcaaggtcttgctaggtcaagagctttgattcttgtttcgtacataacttggcttgtgtttcctttcactttcttcactgatatcactctcgtcgattgtgtggattgtggtatatgtaagacgttcgtgtacgtatctcttagtccgaggttttcgatgagaagaatgcgttctctatcgtagaaaagatcactgttgaatctactgcatgcagcagcatgatgatagagccagttcgtagatgagatattgcttgttgccgggatgttgtgatttctcttgtcaaagaattctactgcatttttggatgggttgacggataattgttgcggaatgtctattccaagggtatttcttccagtgacacttgtgtgtgatgtttctcttgctggggtaccctctttcaccttcccggatgcacgaagcttaccggcgtaataatcatccgtgatgtttttaccatctacaacaaccttggctccgaattctcggaacacactccttgcagtaactagcgcaatgattctgtttctgtacgaatagggcaatacaccatttttgatgagatcgtctctctctgattgcgagataatcaatttgtataggtttggatggtactggaagaacaagtatgagtctctgaacccaacggcacgggctggctcagtagaaagcatgtatttaacttcacctctggaaggtaccgtgaaagttctgactacaaattgtcttccctctagaagatcaccattcttggtgatcttggtttcaccctctggatcctcaggtaatgaatactcgtcattcacaattgggtatggagacccgttttcgtccactgggtacggtagtttctgtcttaagggatcgttcaaatcttcttctcttttcctctttgaaggccttcctcttgtcgctagtaccactggaacaggtgtgctcgaagcggccttgcgcttggaacgagatggtttaccctcgttttcgatatcagcatctgggtcatcatcgtaatcatcatcattggctggtccagggtactcttgatccttttcatcatcttcaatgtctaactcgtctgtatcgattttatagctggttgctttgttagctgagcgagaaaccctcgagctcttcctgcctcttcctgctgctgccatatctgatataggagaaactcaagcttcttgattggtgattccaaatacagaattactaaggaatgttatgcgtatatccgctttcaaccgagctttgttgatcttgtttgtttatatataagctttgagaggcaggaatctgttcaatgttcaagagaaacatcaaaacgtatgagatgataaagaagaaagaacaacttcaacggctttactagaagctctagatatttctgggggggggggccttgatgcaacatctgatcctcctattgttattcattgtcttatatttcgtacgttaactaactgttaaatacttttatgtgttactggtaaaaaatgtgtctcattcaaaactcgacggtccacctcttgatacaggcgtccacaccggcgctgacgatagtggaatcgttttcccatagtacactggacacaccgtccttttgtgcgtttaatctttttatcactttcataggtttgttaacagagtagatgaagatgttggtgtccagagagccagtgacaacataatcttcctccaaatcatcatcatttgcagaaggtctccagtcaatggatgtaattctgcttgtgtggaatgaccatctcgaggtcttgacgtccttcgtgtcaagatcatataggataatcttaccggacacgtcaccggcagccaagtacttttgtgatggagagaaggaaagagcagatggagtggcacgtaatggagtggccaacgtgaatgcatctgataggtcagaaattttgaatagctgcacggagttggtttgttcgtatgccactgccacgaaagtagttcccaatgcgagggccccgacaggtttatctagagttatcgatttcgataatagcccactcttgttatcgatgatcaacaattcgttagtgtttgtagcaacagccaaagtgttatgagagaaaaccgcacatttaggttgctctgagaattggtacttcgtttcagcaagcgctttttcaccatcgatgaaattcttcaacgtttcgtcccaagaaacactcgatacctcgttatcagagttatcgatggccaatacgagattaccatgaatatcatggctaatagcattgacttcgtcaccttctgaattccaggtaacaactctaccatcgtatgacccagacactaatgggtttaccgccaaagaagtaatccccttgttgtgaccatgaatgaatttgatggtatgatcatttagagacaaaatgctcaaggtcccatcaagcgtcaatgttacgatggagttatccttagtgacaacaacaccgacaatttgattcgaaacatctgcacctaatttccaagactgttggaatggatcatccaacgacacatcccacaaccttgcagtgcaatcagcacccacggtaacaactctagaagactcttcaccatcgtctaaccatgcgacagcaaacaaaccaccgccaattggagccttttcagactcaatgtatttgataaattcaccagtcttaccatcaaagcaacatatcttacgatcgctaccgacagacacagcatatttccctgcacctggagagaacttgacgtctctaacgaatttaccttggccgtgatgcgttctatcactgcttgcaaacttgaaaggtggaccctggtaaaacacaacagaaccatcatcactgacactgaaagctctcattggtctgctttgcttgaaatgaactgcattgactctttgagagtgacccgagacttcacctaacgagttgcccgagtcccaagagacaaacgcaccaaacctatcacgaccttcaccaacaacagccaatcttttaccctcaaaatcccaggatatatcagcgacaggaccagcgagcacatgtagttccgacttaacgttgtactcaatttctccagacttatcgtcctgattccaagaccaaacgataactctaccggaatcatctcctgaagcaacatattgagacccctggataggagaaaattttacaacagtgacattactggtaccatggccattgaattgaacgacatgttcaccatctaaagatctaatgatggcagatctaccgctaccataagctaaactgtcagtctttggatcatatgataaatgtgtcgtaaagtttctctttgtagaagggagaggtgcaaaaacctttgctaaattaatcgaaaccatattatcgcgagatactagatcaattgacttttggaacactctgtaaacgcaccagaaagacctcttcctgactcaaacgtgtcctgttctcatggtttagtttcttgataaactggtgagtataaataaattccatacatatggaatgtaaatagacgaaataataactactgggatgcagaaatacaaagaaaagatatcctaaataccagttagtataatgaaagtggtattgctgaatacctgggaatcaagaaaatctgggaaaccaggttaaaagcagataaagggccttaaaggccctttatctgcttgtaaagtacagtgaacggttattcttctctgaaaaatcacaatcaacgagattcttcgagtcttcaaagaaaagaaaccagattttggaaaaaaaaaatgattgaagccttagctcatcgcatggttgataaaatagatttccctgtaatttgcgagttatatcagtcggtttggtatcgtcagactactgttaagtgatagaggtgattcaggcgatcagattggtagaaatattgtgaagaaaatgtcgtctgtgagacctagagtgacgccggtaaaggctcctgtgttaccaaagcagaccaccccagagcagaggtactggaggtcttattcatctactcagcttgttaaagagcacaatgcagtgactcatattgccttcaatccccagcatccacatgattttgcagttacctcttctactagggtacaggtcttctcgtcaaggacaagacaagtgatcaagacgttttctaggtttaaagatgtggtgcattcggccactttccgtcaagacggtaaacttttagtagcaggtgacgctactgggttagtgtccgtttatgatagttataatccacgtactttgttgctttctatacaagcttcgtcgcatcctacgcatgtgacgaagtttcacgatcaggataacaagactttggtgacggcaaacgacgatagagtagtgagactatgggatgtttctcatgcttatgaacccactttacagttaactggagcatctgattatgttagatcagtctgctttgtgccaaatgctccacatatggtcgctacagggtcgtacgatggagtagttagattgtacgatattagaacgaaatcagataaaccacagacaactttggatcacggtcttcctgtggaagatatcacagccatatctcctactcagcttgcatcgtgtggtggtaacgggttcaaagtatgggacttgactagcgatagagccctttgtgaacgtcaaaatttcgcaaagacggtcacctgtttgaattacacaaatatgggagaagaatcaccaatgagttccgtactagttgcatcctcgcttgatggtcatgttaagatcttttccccgttggagaacttccaattcaagtttggctggaagtttagcaacgctgtgctaagttgtgcagtctcaccaggcgatgcgcaaggtaataaacatttcgttgcaggtttatcctcaggaattctagccatcaagacgaagaagaagtccaaaaagattaacctcgctgatgtctctgatttggaggatttaccattacaacagcaagagaagtctgcgaaatccaacaatttccagagaatgatgagagggtccgaatacagaggtgatcaagagcatattatacacaacgataagccaaatcctcagcgtaagttgcgtcaattcgaaaggcatatcaaccaattcaaatggtctgacgcattagattctgcatttatccccggtatggctaaagaattaactttaacggtattacaagaactaaggaaaagaggtaaaatcaaggttgcattatacggtagagacgaaagttctctagaaccactactcaactggtgcttgaagggaatagaagatgttagaagtgcaccaattgttgcagactggattgcggttgtaattgaactctacggtagtgtactggagaagtccccagtacttgaagagatggtaatcactctaaagaaaagagtaagggaagagatccgcaaagcaaaagaagcacaaaagatagagggtatgctccaattgttaacaaactgataaaatcctttctacactgatctataacaaaaaggaatgcgtgtaaaagattatatttatttacatttatagtacatagactgcaacaactgtatcatcccgttcgttacgtctgtttctttgtttttaacgttctgactttgaagaaatcaccttcttcctctccatttactggctctgtttcttcctgcctttgttggaagattcaaacgcttgaagttgttgctaacaaggttgtatttactcttacgttgcttcttctttacgggtggattggattgttgttcagagtcagactcactttcttccacttctttacccagcattttattgtactcacgttccttcaactttgctagctgttcatgaacatttttgtctggaatgttggtcgacttctcgtttaatgctgctggtctcatcttcgcttttgttcttttctttatggttttaactttccgcacataattgctctcagtttcattgccgacagttccctcgtccccctcttcaattatatccatatgttcttcctgcatcagcttttccataagcgttctaatcgcagtgaattcgctgaaatcttctgggttagattcgaattcgtcttttataatggcatgttccttcgctaattgggacagtgtcttcaccggccttttaatcagcggcgatgggctgaagggagaacttttcaaatccagggttctaccaagcgtctttggtgtttctgacaactgcaatccaatatcgccgatccgcattggggagtttggtccatatttcggtcttgacacaacaatattcgcagatagatttggaacttgcttcattggagaagagttcggcgttattgagaagttcaattggcgccttaccaggtcatttgatcttactggcgagccaactatatcttcttgatccgactggtgagttttcatggcagacacttgcatctcaaatatactaactaatttcccattcatttgaggagtcggtccgaattcagcctttgtgttattcacatgcgacttcactggtgtttgctctacgttaacctccaccgatggtttaacagtagcatccttcttgagctgtgcatactgtttatactttctcttgacctctttatccttttttatatcatctttctcaggaagccttccatgctctttctcgaaagcacgctcccacagcttgatctcaatcttaagagcatccatactagcgcttgatatcacgagtaacaacggtgcatttactgtatctgtctcttttattccattcataaaggtcgttagaataaaggcaaagaacgaaattaaaacgcgtaaattattgaagtttcccatgaagaagaataaagagaaatgagctgcaaaagattcacgatcacaggtcaatcagggcacatgagatggaatgtttgataccaagctgttcctcagtttaccaatcgatatacggtatactgtttacttctttttgggcgacgttgtgcaaaatgtaagaccacctgctaaatcagatatctttaacgatgagcttattgcctatcctaatataagggagttcaatcaatctctggtggataagtactctaaacatattggtgtatatgactatataccaaatttcattcccaattggtgccgagacttcgatttgcttcgacatgacataatacttactgatcgactgcgggtttgtttacaatatgaggaacaatggtttagtgtccaatggatcgtagtgtcaggtgagcttgaaataggaatattcactacagatgagcagtttctacaggtgagttataccattaacgagtattgccatcttttgagtattgcacaacaagatttgaggttaggaattaacgtcagtgatatcaatgatgtcaatgaattatgcaaagagatacaacaccgctggctatttgatacagtttcatatattagtttcatcaattgctgggatttagatcatgagaacgtcgtttctatcattccatgcatggagtcgttcaataacttgcacatgcttcgcattgaatcgaagaacatgtttaataacctgattaatactcaaggagttcgagagaaccctggtaagacaatagtatacaatgtccgacaaaatatattcgaattagagctgtatacgttgagggatttggggtacaaatctgttgttgatttacaaaaatgggaacaacttcaatgtctttccttatcaggttgcgaattcatagacctcaataaccttattttaccacaacattgcaagatgttgatattaaaagaagtgaagtatatcatatggtgggacctgtctcatctgttgaaacgaatcaggcctcaatggattataaatggtcaggtgaaaaaacccacgaagaaagaagaagaagaggaatcagaatggtataacctttatttagaagtggtacaaacataccaacctctgaatttcatagaactgcacaacgccaagcgagttaaaggaaatctaatattacctgctcgtttagtaaccgaatctagaataaagatttctaatgggactaaggtagattctgttttactgatataagagaattgtgtccaatgtgtacgataaatatgtcaattcattagcgcgagagaaacagagaacaaatgtacatatagacttataaataagagcaatataatgaatatagatagggagagtaatttcgtgtcattcatttcatcaaacgagattggaggaccgtgaatactaataataataataataataataataataaaaaaaatcggtgggtaataaaggtaaattattgtgtcgttaaaacattattgtcattggaatcgttggaaggggtcattaaaagggggtgcttgacgtactcattattcgagaataataacggtgttaaatgaaggaaaaacatggttagcggggataacataattgacaaatcgtcaaagaaaggatgggaaacaataaggctgactacaacttggaattgaaaatgtaagggtggaatgaaagtaagcacatgttgcggcaaaagataacagcaacagattagaatggaatatgacaaaattaacacgatatccgaaatgttactaaatttcagcctttggtcaacaaagctcacgtatatgcttttttgtagaacactagaaacaaaagcagagtttagcgattgtaatatgcagaataagaaagtgttagtccgagaaaaagatacccatcttgagaaggtccatatcttgttcagtgttttcaggacctaacaactttgaatccttgtcgtcttgttcttccattaattcttctagtgttggtgctacaaacggtgtatcattaacatgttcacttaaaggatcgtctggatctatgctattcaaatttaagttcataaaagaattttcgtcatcttcgctgagtttcaacagcaatgacgagggcaacgaatcatcgagatcgattggcaaatcgccaagtttcgaaccagggttcttagtcagagcatgtttttgtaagaagtaaagcatactagcatcttgctccgcgttataagcctttgaattcgctaacgtatctgtcattgggtcttcttctttaatgcaatccaattcatcctgatgggtagagtggtgatctaccttaagcttttgtatagatttcaaaggttcttgagaatgtgaagtcgaaagtttgtatttggaatagaactccatttgctcataaccatccaagaatttcatagcttcaatagtatcagagaactgagaatttggtaagctcttatttgatgtgtggctactacttggacttgatcctgtattcgtcaaggtagatgaattggaaagaagttgattgctcacggtacgatttaagtcggtagagaataaagaacttggggtagatgatgatagtaacagatcgtcttcatctgtcaaacttgcacgagaactcaaagaagaggtctgaaccatccttgaagaggaaagatttttgatgaagtctctatttggttcatcatcttcatcgaatttcaaaaagatttcagtatcgtctgcaggttctggtttcacttcgatttgtaacatatcagcatcattgtcaatgatagatcttttacgaggcaatctctcagtatgttcttgcttcacatgtactggctcatggtacgatttatttgtcattggttttggaagaatcttctgttgcattggaacactgctgttgacacttggtactatggtatgtggagatttagaatttgattcttctggtacgatagggaactgacgtttcaattcctgtaagttacccactagatcggtaagctccttcttaagcttattgttttccatcttaaggatcttgatctctttcttcaaagcagttttggaacctggttttttctttggctccacgggttgtgcagattgaatatgatctaaagtaacatccagctgttccattttcacctgtggcttaacttttgcgctttccattttagctgatggctttaaggtcggaattggcatgacttgtttcttgcaagcagctggtgcaattttggcacggatgggcttaggctgggtatgagtgatcgatgttgtctgttcaacttgtattgcttttgacttggcgtttgtagatttacagttagtcaacgggatagttgatgatgatgatgatgatgaggagcttgcggttggcactcctgtacggactgcagtcgttgtagatgacgctactgtaccttgatcagaagaagagcaacttttaccagaatcaataacagtggcagccaagtgttttttcgatcccggtctcaaattctcaacttctttcactgattccacaggttcttgtttaatcttggcattagtacttgaagcagaagcaggcgtagtggactctacagccatacccttgacatttgccagttgctgctttatcgataaagaaggactgggttttctacccggtttaggcctcggtggaagaacccagtgcctagacgttcgaatcgtgatcccagtgggtttctcatgtttcttcggctgtaaattaggagcaattgtaatctgctgatgaggcccagtgtgtccgtgaaggggctccaatgaaactggcctggacattagttaattcttactctgtgtctgaagtgcttttattatagaattctctccggaccagcgaaaacaatattaactggttcggaaccggagccgtaaccagagttgcgaagtatgcgtttgaaagtaggatacaaaaaccttacggcgagatgcaacctaaattagtttgaaccacctgcgatacgattgaatcacgcttgttgagtccttgtgtgtctgttagaacctgttttagtttcggagaagtcgtttgtttcggtagaattaactactcaacttttcaatttaaaccgaaattgagagagagagagagagggggaacaatggtaaaaatgagggcatgatacatcaagacgagccatcatgaatttatatatctcaggccataagatagtatggcctgagtactaagaggtatctcaagtttgaaatggggattgggtgttgagttgctaataattgatcacgtgaccatgaccccagatacaaagccacgctcccaaactggatcccccccctcctccccgttacagtactacgctagtactagcatgctgaattcacatccccaatcaatgcaacagcagcgtagctgctgttgctgggatcacctatcgtttaatttcttgatacctgcgtcgtttccgatgccacattctacaatgtggaatgagaagctaaaacctcataaaaataccctataaaaagcctgaatgagcgaatgcaattacaaactccatctgtagtcattgtagactagctaaatcattctaatgaggcatagctgtcaaccagatatatagttatttgacggtgtcacagcaaatatgtggggctggtcttgacatccccgggtaaccccttctgttttcgaaaagtcatcgaaaagttgagaacagaaagaactggaactaataacagcattaaacactaaactactcatcggattaacttctaagctttgtctaagaacgccgttccagttcgagtaaactgcgcatatccaagaaatacaacaagactataggatatggcacacagagcgtttatacaggtgattttcaccggggcacaggtgtttggacgtgcgtttgcggaatcttacagacaagcagcagctcaaacagctaaacaaacggcaaatgcttctagaggccgtggtgctagcgcagaatacggaggtatcactttagatgagagttctaagattttgaacattgagaatgaacaggatatgaatttggataaaatcaacgaaagattcaagtatttgttcgagatcaacgataaagagaaaggtggatcattctacttgcagagtaagatttacagggcagcagagcgtttgaagtacgagcttgctgaaaaggaaaaggctgccaatccagaactgaatcaagaacaagcgaagtcgagttccacgacggagtcaccggagttgaaaaaatagcgtaaggtcattctctctggcctagtataagttttgtaaatagttcaaataaaccgaaatacacgcatcgcatgctcatcgtatcatgttcagcacaatatcatcagtggttgatgaagctgatttatgtctacaactaattaatacaaaaattctctagaagatgggaaaactgttccatcatgaagaagggcacaacggagagtgaaaatccaaactctcaggcagccattacgcaaagccctctggatcacatgcaacacctggaagaacaactagagcgagctgttaaaccgcttctaatcatcactttccagacctcttcataatggttaaaagaaagaagtgatgcaaaaaaccgggaaaaggaagagacttcccctcccaactcaatgcgcttccaactttattgatctaagaaaccggaaacgaaatggaaactgtggccagcttgtttggggctagtcaggatccattcagctatgggttaaaaaatggtaacagtcactcttctccagtattaactaaagccgttcctagatctccgaagaaacctaggaaaaacttcttgagaaaagagataaccgaaaccgtaggtttctatggtgtatatgtgtattaatattatcttgagatagtactaaccactactgatgattggtttattaagaacaaacatcaaaaagattttccaatctttgaactgtaagagtgtttgaaagaggttcaaagtgttgaaaaatttgccacttttatactattgatcggaaagattacccggacatacgtctctactattataattgatttagggttttaccaggtaagatatcgttgaccagacaagcatgttgcagatatttggggcccttcatggtgtatattgcctagtcgagaatcagtttatatgaaatgtaaatctgttcatccaagtgggatcttttgagtcgaacttataagcaatatactgctcatcttgcccatgcagctcgtcctactcactgcactgcttaataagtgtcaatatccaggaacttcggttacttagagtagtacccagcttctgggctgtggcaccagcagtaactataccgtttagatttatatatagttatagaaaggttcgggtattaatgtctgtcagtccaagataatgtgacgttaacaaccatttgacagtaaagcttccgaagctgctactttcgatccaagttctcgagtctatgattcttcatgagatcacctggacagccacccaattgttacaatagacctcttgttggctgatcggttccaccttttctttcataacttgagaactctcatcttttaaagtgaaaaagtctaatattgagagatgagccttagcaactgagaaagtaactactcgtatccaaacaacacagtaaaaggatatacatagcactggaataatattgccaaaacagtcacaatgacgaaagaggatgctattgagtatgctataaaggaattgcccaacattttgccactagatacagaacagatcaaagatctatgtgaacagacgataaaagaaggcaacaaccctgaacagatagcccaatccttttttgatcttttagggcaagacgactcatcggtacatttcatatttgagttcaatgagaggctcatggaattgccccgtaaaacggctgtcaagaaaccaatagtgaacgaaacaaccaatactaaaaaagtgatatctccattgattaatactgtgaaaaccaatgattccagggccgagttcgccaacaagtctattcaagcaacgaaaccgatattgaatagagaattaaaaaaggtaccgactgccaaggctgtgaaaaaggattcggggaaagagagtaaagaagtcagattagattcattgaaggatatcgatgatgtgttaaagatgttggagatgaggtcagtctctggggattccggtcaatataaatgcaattgccagggaacaaggcacccaatattcgatcctgcaccaaactgtctgtcatgtggcaaaataatatgtgtcaaagaaggtttgcatatgaacaattgcagcttttgcggagctgaattaatcccagctaaggaacgcgaacaaatcttagaattgctacggttagagagagaacaaatagagcttcagaaagttgaagagaacaagcccaagccgaagcaaaccaagaaatataagattaaatctggtgcaggcacaaatttatggcaagaacaagagaaaatgctacaaagagtggagaaagatcgggaacaagagagagagattaaacgacaacaaatattgaatggggagtcaaaggaagaagaggaggatgaacaacttattgaagcacgaaatcgactcgacaagctacttcatttccaggataccagtgctgaaagaaccaagatcattgacaatgctagtgatttcgctatgaatgaagatgtcatgtggggttctgcttacgaaagagcattacaactaaagaaacagcaaagaaatttacgaaaatgggaaaagattgagaatgaacgcaatggaaggcgtgaaaaggtcgtcttggacttgacgatcggtaaggatggtaaagttgttatgacagaagcagttagaaagagcagcaaaaaaacgaatgcaactagtgatgatgaaatagatgatattagcgatgaagaagatctccaagacttggaagatatcaagaatttgaagttagagataaatcaacaaaaacagaaggagagttccaagttaacaaacaatgtttgggattataacaaggcgcagtcggagtttaagaaacctgtatacatagcaaacgctgaggaagaaaaagaatctgctcctaaaaaggtatcaaatgaagttcatcgtgtccaagtaggtattgatgatagaccatcacttcaagatagcattttggcaattttgtgaaatttgtctgcccggaccgccgatgtttccataatcaataaataaatgtgttggaaaatttatatatagttacatatcgagcaagcgttacggttggaacaattcgactatcattcaatatcgaaaattggtaagaactggcccattattaacattggaatattaaatgcatctcttttaactgtccaaatacatgcacaccgtagatagcatccattctttaacaaaaggttacattcgctaaaaatagcctgaccatcagaagttccggtcgatgaattgaagggcccactttgagttgaaccaaatgccaaatactcatggaatatatcatagtaatctactatgctttcattgtccatgaattccatgataaactttcgtttgtttaaaatctcctttttgttgaacccggtaagggatataaattcattagaagcaaagcatatctcccctgaccttctccatatacacattggggtacaatttacaagtttggccatgctttcatactctaacaatgccctttggagaataatttcttgtaattttaaatcttgagcaattaaactattagttagtgtaacgaatattggtgcataatgtgttttaatagagtgggctatattttgcaattgctcggggccatccctctgagatttacccgaggaaggtttatctgaattaatgaatctccatctcaaaaatcttaacagttccagataagctgacttataattatgcggttgaattaaagcttgatgtttgtacaagtcctcaggtgtcttaaccagtaatctaaacctgtatggactcaaattctccacagtttcaccaccttgagattccggtgacgtatcatttgcagaatgccttttagattcacttgccatttgatctaacgatatgtgcggcctggaatgcgtccttttcaacccattgcttgtgagatttagcagttcctgagtattgataggtctttgagattcagtgataggatccattttcatcatgttacttggagaccacgctatattggaattcaagtatgtctttgagttatttcgggaaaggtttggtgtcgatagcatatcattgagctttgtatattcttccgtagtccatacactcccgaactccccagtgctactgttgctgctcgtatgatctgaattcagcttctctgggattggcagcagctgctgtgctggttgttgcggcccctgctgaggtgctcgctcagaaagtggtttattcttaaattcctccaagggagtcttatcagccagagagggtaaattggctgcactattctgattacttggcaacaaggcatccgagataatgggctctgcagttgggttgaataactgagtgagactgggaatcttcggcaactctggcgacataactttcttctgtttcccaaacatatcagatggagaatttataacgggcatttgtaacggtaaagaatccatagctagcttggagatcctcgtcttctttgtcgaaactccagtttgcttggcctttattattttactcgaattttgtctattgctaacggcagttgcagtattaataacggggatcagttgttgattaatagtattagatatctctgactttgtcgacgccgaaacctcacgttccttcttaactttccgcggtccgcgtttcctgggcttacgctccttatccctacatgtgtcaccaatcccacgcttcgagcagttttggcagggtctaccaagatcacattgtaaatgcttctcatggcaaaacacacaagctgtcggtatcggttttcgattcagtttctcttgagctgtaagtttcttcgtcattacaaaatataccaaccataaaatacaacttagttcttataataaatagttccggtcgaggaataataccttgttgaataccctggtctcttccaaaattagaaaagcgatcgaaaacagcgatatctgaaaggctgaataactcagtattagagtcttgagtagcgaatgtctcagccaggtgatatgtaccgtttccggtatataagaagttaatttggataattcaaacgaagttcttaaatcttgtttgtcattttctttatatctggggaaaacattcaaaaagtgttgatgatttattttgaatcagcaaagggttcaagacgaactggagtaaatcgcgacctttaaaaactctcgcttagtatactagcatttaaaagctgtactaagggggtaaaagattggcttttagtgtctatcaaatgtttatgtagtgcaaatgttagaaatacatgagttttgaataaagtatatgtagaagttggctggagtgagtttacatttatgcaaagttgaattcgtcgttagattgtctcatggccatcttggccatacgtagcattttagacttcgagtcctcttttggtttcttttgggaagctgcagcagcagctccggctttaccttgctggagacccatcgatttaggtctttctcttagggcaaatgatttggccaaatgaccaagatgtagacatttaaggttgaaaaacttcttttcgatggaaagatgggtagcatacgctctgatgtgggacatgtaccccttgacagccaattccttgaagtgagaatcttcgattactctcctttcaacgtttaagtgccaagtagtagcgttgttgtcccaagcttgtgcttcatgtttgtcccaatcttccttctttttatcggttcttcggacgttgagcccctcgaatgcaggcctcaaaacttgctcgtcgtatgtgagtaatttccaaccttttggatggtacggtttgatgtagtccatgtatccttcttcttcaccaggtaagaggaatagtagagattcaccttcgcaaccagcacgagcagtacgcccgattctgtgtaaatggtcttctactgcaaacggtggatccatttctataacagtactcacatggggtaaatcaagacctctggatgcaacatcggtacaaaataagatcagatgcttacccttggtggcatcgttattcgtggcgaagtgttttaaggttgcggttcttgtttgttgcgataaggacccatgcaacttgtaacatatgacgtttggatcgtccgtgtcgttgaaacatggaagtatgctgttcccctttgtgagaagccttgcggtatctccaacgagacctctatgattcccatcatgcgatgaaaacacttcgtagtggaaatctacactatcagaacaagataaaaacacaatggttcttgttacgtctgattttgatccttctttataatgcttttgagttatagttgtcaaagatcccgctagagtaactagccttagctttggtggcactatgacaatcttttgaagtaattgatctggtactgtagtagtttccgtttgtttttgaccactgctaatcaatttgtagttttgaagcgttacattgccaagttttgtcacgttacctttcacagtagcactacacaagacgtgtaaaattctctttggcaacttggggaattgatgagtatctatatcgataccatgaatgatattgaggatttccttcaaagtctcttcaaaccccaattccatcaacttatcaccttcatccaaaacaacatatcttaaacttggagccaattgttctttaatgacttttgtgttctgtaaatgatccaatactctacctggagtaccaatgataaagttagcaccttttctcaatctcgccttttccgatttctttctttcaccaccaataaggagacatggcacaaggaaatgacaacattgagcaagctcagaagtcacttgataaatttggttggccaattctcttgttggtgtaactacaagtgcaaaacatccagattgtcttgtgatattttgacccaacgatagtatgctttggaaaattggtaataaaaacgccaatgtcttaccagaaccagtttgtgcatgaataaacaagtcgttttgtgcttgtaagaatggtgggataaccaacttctgaatcttagttggcttagaaatcttcatcttgacgtttaagtgtgaaaccatcgtgtcagtgataccgaacgaatcgaaggtgtcaccaaccaatggtgcattggaataagtcacttcggctttttcatcatgagcattactattggtaactgtgtcaatatttctactggacgtgaacaaagaggaaacgatttgcgagtttagctgtaatggttgcgttaccctagctggttgttctacattagaactgttatcaaatcttgatctcttaggttctacaggtgcctgtgccgaagttgaattcgaagaggaggcttccaattcttcaaaagttggtgctccatcagattctaatggtctcttttcacccctgaccctcggtttacgaccttccatcatcattttggcctttctcctgtccttccatttaccaccggtaattttacctctactgactgtttcactagcatcactaacgtcagttgtaaaatttaacagcattccatcatcgtcatcattgaaactcatctttacctacttgatgatcgttgatatgggctgctgagcgacgtacagagactttcacttcatctaatgtcagctcatcgcacagttaagtcctacttccatattaaaattttctatgcttgatgtcaagaaaaagcaatacaaaggtaaatactcacagaattggataaaatacagttagattggcgactatcaggatcgtttgaactggacatttgacactgtagtggttcgtgctatgtacaggtcatgttatgtgctgaaattgatatctctttggtttcattactgattcaattctacaaaccttgtctgaagtttaatgttaaagcatattatatacacgtagaaaggcagatggacagagacaaaagtcgcttatgacaaatattaataaggtggtgatgaaatactcgcccagccggtatggaaccagttggaaggtgataaaccatccttttacagacgcttctctcttcttgtttcaatgatcacaagacacggctcatcgcatcgattgaaattttgacatttcggatgagaaggctcactcattagtacaactaatgagtgttgaaccacttgtacaaccaactattgtcctgtttctatccaggtatctgtaagagggtgtcagtggtctcaaaatgtctaatggtttgtttgttaccgatgaggacggtgatactgagatgaatgggaacggtaaactcgataagaagctccaatcatcagagattcttaaagaagacgatccagtagtgaatgaaatacccattaatttaacggttggaccttgtccattgcatgtgttacagtttcctaacaaacctaaaagactggcgaagaatatggatgaacatcctccaattgctggtgtacgctataaggatgaatcaagcgtttgggagatagatatcccattgaatacacaggtcttcttcgacaaagaaaaagctgctgagtcttggaacaatgtcgacgttcaaactttgaaaggtgtggctgtaagcaacgacatgttgcaatacgcaggcgttatgaaacaaggacagctatatttaataccagtagagaaagttgcccaaatgagaccatacttccgttacatcgattcgcatcaacaggttaagaaggacgaggatgccaaggcgaaacctgcgaatccaactgccaagaaaaaccaggtaataacaatgtcagtgaagagtagcagcgaagcgaatcaaaatagactaggaggtgcattgctagctcataaggtagcagacgaagaggaattcaaacctttggaatggaaggacgatactttcgaatcgtttgtagaagaagttacaagtgaaaaaagtactgtaccattaaaaccaatggacaacgacgctgtgtatctatcaaaactattttaattaattatcgtatttagtaagtataaatatatattaaaccgagaagggatcaaattctccttaatcataccacatcttaatcaactcctcagaaacagcactaggtgtcaaccctccaagatcagtgatcaaagctgtgatgtattcttgacttgtaaagtcgacagaaggcccactcaatggttcttcatcgtcttctataccgtttttgctaaaatctaatggatctctttccattggaatatcatctgacgaaagagggaacatacgtacgaacttatgcgactcactaaccacatagaatggtttccttgcattcttcgccaagacaccgatagaatacgttcctactagattgataatacctccagattcagcaacaccttcggctcccacaaagatcttgtttaccttatggatgatcgtaccaacagcattatctacaatcattgtcactgggatacccttctttttaagtaaatgatacagttgcaacccttggccagacggtctggattcagtgacgatacatctaaatctgattaacttctctgctgcatgacttagtaaagagaaaacagctctggaaaatccatgcactaatatgatatcatcatcggatatgaaatcaatcccaatctcagcaattctatctcttgattgtttagctctactgacaaataaatgcccgttttcaatcaaatgctgttgacaattttcccaatcaccgtacaaatgtgtgttcttcaagacaaatctcataaatatatcacaacctgcacgtaacgaaattgagtttggaatagatgtagtcaactcttcgatagctagctttgtcgatttgatcatctctgcagatgttttgggattcttaactttcaacatggtaactaatgcctcgatggcagcgataggcatagtcatttcactgtcttcttccaaaaacttcaaataagtttgggtgatattaaactcttgcatcgtcatttcgtttggtatttctctattgatcctgtttccttgcactggtatgtatttaatgtgtcactgacagtacccaaatggccactaactacctagtttaattgtctttgaacctcacttgaaccattttggctggttggatgagatggttccatgctttcaatagtgaaaagttaaatccgtaagtcatgatttttgaaatgggtgatgagtctgaaatgttgttattaaacaccgcacagtgtgccacttggctcatcattggaggtactagttgaatccttacaattactacattctcgaaatgtctacttgttaatcctggagccattggctgatatttaactactctttatgtaatgtattattcgagtgctattaaactgaatttattgaagacaatttctaacagtaccgtaaaccttcgagacaaccatcagaaagactagtataaccagtgaaggttcgatttcataccagatacccttaccaagctctgcaaagtagccaatgcaacatacaatgtcgtttaggatatttcttcgaaggtatgccactaagcatgatctgagtaaagtcagaaacattggcatcatcgcgcacatcgatgctggtaagacgacaaccaccgaacgaatgttgtattacagtgggaagatcaatagaataggtgatgtagatcaaggtgatactattacagactatctaccgcaggaaagatcgagaggaataacgattcaaagtgccgctatatcgttcaattggaagaaagattataagatcaatcttatcgacacacctggccatgctgatttcacattcgaagttatcaggtctttgaaagttctagatagctgtgtcaccatcttggattctgtagcaggggtggaggctcagactgaaaaggtttggaagcagtcaagtggcttacccaagatctgtttcttaaacaagatggatcgagtcggtgctgggtttagcaggacagtgaaagaacttgtcgtcaaaatgaataccagagcattacttataaataccccaatatttcaagtagatcctgtgacgaatgagtcaaagttcagtggtgtgttggatttaatatatgggaaacagttaatctgggacaccaatgatccagacaagataaatgtcactgatgtcgatgaaaatcatgactgttatgaatatttggttagaggaagagaagcattggtggaaactcttggtgagactgatgaatctattgtggaacattttttcaatgatgctgatggagagtacctaaatgtttcaccagaagtgttgaatgcatctatcaggaaagccacgatctctttaagtgcaacgccagttctttgtggtgcatcttttagaaatatcggtgtgcagcctttgctcgatgccattgcaaactaccttccatctccttcagaagcaagacctccagaattgaaccacaagaacgtgccaatcacgcaaaaccctttaactggattggtattgaacaaaaacccaaacctgtgtgtcgctttggcctttaaagtcattacagacgcaattagaggtaccatgatctttatcagagtgtattcaggagttttacgttctaaccatactgtctacaacaccacaactgggaccaaattcaagattggtaaactagttaggatgcatgctaacgttcccgaagaagtcaacgaactatatccaggtgatattggtgttcttacaggaagcaatgtttcggaacatatcagaactggcgacactattgttactcatgtaaccaagaaagatgggttacgttcttttgataagaacgtagagctcacattgaagataaacccaatagagatccctccaccagtatttaatgctgccattgaaccaaaaacattgggtaacaaaaagccaatggaacaagctttgtcacaattgactagagaagacccctcccttgtggtaacacatgatgaggagactggacaaactttgttgagcggtatgggggagttacacttggatattgcgagagatagactattgaacgaattaaatgcacaagttgatgttgaaagagttattgtctcctacaaagaaacattaaatcattctacccaagaaaaaacgttggaaaccgatgatggatacaagattaccgctgtaatcgagccattggacgaagagatgaaagctaaagcgaagaaggacgaagaatggttctcgttagcgaatgataataatttcatgatcatggaaaagcacaccaagtatgacccggataaaaactggcctttccaagtgccttatgttgctgtcgtgaatgcgttattaccaagttctctagttgcattacaaagaggaggtaagatcggtgggttcccattgagctcttgtgtcattcgcattaaaaatgactgggatcttccaattgatgcgccatcgatttcaccattgttgactttaagcagacagctatttactcagatactcttaggagaagatcaatctaactactctgttttagaaccagtcatgaatgtcgatgtcactgttcaacagcaagacatgggacctgttattcaagatctgtctagtgcaagaaaagcaaatatcttgtctattgaagatgagaatactaatactgtcagcgagtctaacataaggttccaacacattgcagacaagatgtggctgcctgaggatcctactttagaattcgctaaacttggtaaagaaggacaggcacccaagatggtgaaagcccaagcacctttgaaagaaatggttgcatacaacaataaaatcagaagtatcacacaaggtagaggctcattcaatatgtattaccatggaatgcagcccgttactcatgacagactacaatcagttttggcagattaccatcagtaaatgccgcttcttattataaatatgtggatataactcttgtatatagaataagatatatcaacactatcattatttactataggatgcagtttagaattatgttcggagtcaggcatcatatacaaacttgactcacttacatctctaaaacttacactggaaattggcagcataaggtccagaatatggtcaacatcgagagtgaatatggcaagttcttattcctcgtggcccaatggtcacggcgtctggctacgatgttagctacttctgaaaccagaagattccaggttcgagtcctggcggggaagaactttttttgctactttccataagaactacttttgaaagaatgtaagctgcgatgaacagacaacatgaccgcggtattcctggttcctccgtaacagctagcccatactgttcgagatcgataaccccttgtttcatttcctttctcggtctttttttttttcctttgatattcggtttggtattgtattcagaggaagaaactgtgtaaattgtaattataagatctatgggctatagtatactgttctgagttaaatacattgcaagttcttcacccaagaaggcgctcaattcattctttgagtcgtcatagtgagtgattctataagacaaatgcaaaacgtcataattaattctttgagagaccgatgatgtttggtcgtactcagggtggttcaaaatgtaggtacggataaagtttgcaaaggagggcagcttaccagaagctctgtcactgattagttttaagtagtggtacaatctgaccaattctgcattccctgtattgtctttcaattctgtccaagatttcacgatcagacctttacgtgctagaattggattgatcaaaatggcaaagataccattatggtggttatggaaaatttcgtcgatacttagcagttctgtcttaccttgaaggtcagagaagtcggatttccaatagaacttctccttcaaagtagcgtcacgatgatgagcagtttccatgtttttccaaatttcagacatgtacatgtaagcattaatcttatcgtcgaaggtaagaatagattctaccaacaaataaatgagattggaatatgcagcattttcgaaatctgtcaattgaacttccatgggtctgaattcgaccctccaaccaggagctcctttattatctggggtcgcactttgtgaagggaccttaaaccggaccgattgccaattagtactttggatattttcgaaatggtcagtttctgtttcgttatcctggtcaatcctttcttcgaagatgaccagtggatctctgatgaaaagatgggcgaaatggcgagccaagtctttatcaagtttgaacttttcgttatctaccaatctcttgaatactttctcattgataggaacctcagtgtcgttgaacttggagtcatagaactcgttaccaccgaggtacaaatccactacactataccttgatttattgatccgtgccgttgaagcataatcttcagttgcgataccaccatacccgttattatacttgggtagcaatggctccactgatctttcatatggagtacgatcatcaactgcacctacgataacgttccaacgcacgtcttgatctgcaaggaaccccttgaatactggagaggcagcagttgcggccaagaaaattggcgcaaaattcaacaaagtatcgtacaaataacgtgccttattgatattaggagcctggaaagtcaattgcaaacaggaacaccccattccgaaccccattgaatccatatagatatatcctggtttagaagctttggcagattccaaatcctctggaacaaaccaatctctttcgtgaatcgacggatcagtttccggtgtacgcacatccttgtatacaggaacgttgatacaaactttctcaccacgtctagtcctaatattggctgtcaacgtggggaacctagcgtgcctattgataatctcatcgggtaaaaacagcgacctactagccgaatttttatgatcccatgggttcttcaaattcgtaaaattgtcacgacccatgcgtgggaaaacagccaacgacaacggagtcaccaagttcacgtcgttaaatttcttcaatttctgttctgccacggccctgcgcatctgcatgttcctctcaacctctgcaccctcgaagtccttatatggcttcgcaggtgtcgcctccaacataaaccgaccgtactcgggatggaaatgaacgttcaactcgtcacactcggcctggtattccgtattcaactgaaccaaaacctcatcatgtttcacactaagaacaacgttctcattagcctcatcgaactcacaaatcatatactcgacttcatctccccagtacaattcatcgccgtctctagactcagcactttcaaaagaattcaacaactgttcaatcccattcacacgcacatgctcattgtacttgcgtgagtctagccatgacatgggcgtcccagatgacaacaaccccatttctctttctctttgaataagcctcccttaaatgcagcgaccaaaaccaccgctaagacagtaccaaacggcgccaaaaccactaccacaaaaaacctgagattgacctgccccaaatacaacaaagaacccactcgaattcctgactggttcaccttctatcctcaaaagaaaactcgttcgataacaatgttgccaagttctaatttccgattttgtctatgttatatatcagctcgaactttttcaaaatttttcagtagaagcctgccacagtttgatgaaaagacgaatgcaagccatatacctacttctagtaaacgggttgatgtcagatatgacctggataacccctctgtatctataactgtatctgtgtttgtatctctacgtttccgtccggtttggaatctacttctgtatatggtatctgcggccaccaggtgtgttggctgaagaaatgtagggttgcatccacgctgactaatatgtagatatatattgtggaatttgtaaaggcaagtgaaagttatagtatagttcggcttgcggttttaggtgtcaattgggtgcggaaacgctgctttacggtcgcatgataaggtatctggtatcaggtaccggctatcagattagtttagacgatttctgtaatgactctaactgattagaaaatcggattggaaaaaagttaggaataaagagcgtacttcattgcagcaatgcaatggctggttagtttgtgtgtttgatatccatcaggatatcaaggctcaaggtagtgcagcaatcctgggattatgctgcaacctgtcgtgtcgagtaatacttatgaatggttgaaatatcaggatgaaccgcattacgatgcaaggacagagtactcattgaataccatagactcgataggcagatggagcacgcgattttggaacgatgctttaagtcaggtgtctcatctggatccggataaggctcgtcagtcacaaattaagattgagtattcggttttccaaccgtcgattaaatcaggacccgtacccaagagtactgatagtaggaacgaattcgatgccgtggtggaagattgcgtgcacgcaatagagtttgctcatttcgatttgcaacggatagaggctggttcctctggttcgtatttcgtatttggtaccgatgctaacttgatcaaaggtgtgtttaagccaaaggatgaggaaccttacggtccgttttctccgaaatggacgaaatggttacacagaactttctttccctgtttctttggaaggtcatgtttgattccaaacttgggttatgtttgtgaagctgcggctagtttgttagatcgaaagttacaagttggacttgtacctcatacggagattatctcgcttagttcgacgagtttttacgattatagaaagaattggttttgcgggttcagaccaagagtacagacgaagttgggatcgttccagcttttcgtgcatgggttcatttctgcagattcattcttgaacaagtaccccttgcccacgatgtacagagaccatgtgatcgatcgcagcggtcaagagtttcattggaacccgaatacgctgaaacagtttagattgcaattggaacggctcatcattttggattacattatgcggaacaccgatcgcgggttagataactggatggtgaaaattactagagagtcagatgacaccgaatggcaggtcaaacttgctgcaatcgataacgggttggcattcccctggaaacatcctgatgaatggaggtctttcccctacggctggttattcttgcctgtctcgattttaaacatgcccttttccaacgaaactagagagcatttcctaccaaggttgttgaataccaattggtgggaggaatcgttccatgagttcactcatcttttcgaaaccgattccgagtttaaatccagtttgtggaggaaacaatggagtgtattaaaaggtcaggcattcaatgttgtggaaacattgaaggatcccagatgcggaccactagaactcgtgaaacgaacaccttctcttgtgattgatggtttcgttgagtacactttctaccctatccaggaaacgtcgttaactttatcattgactgaatctttaccaaagagctcctcaccaatgattgttggtagcattcctgatagatttgaagacactctgcaccaccatccacaccccaactactctgagaatcagaaccagaacgagaaccagaatcacgagcacccagaaaggaagaccgtcattatagaaagattagaaatatgtaattccaaaccaccgttgttcacatggtggtgatagccaatacacaccctaatatacacatatcaattacataagggcagaccatctacggcaacagatacggccgtctgtaacccgtctcatcccatctcactatccatcgttttcactggttgccagatctgctcggcacctttggtatagtaactagaaaaataaatactttaaacagggttttcaatcggataagacacttaataaacgatagttaaagagaagaaatgtctagagacagcaagggccctttgaggtacgtctttccagttgaaagttagtcaatcgttttatttaaagtcaataaagtaggctgagaaagatgagtttgctttggggtagtaagaagaaaccgggttcaaggcccggatcggtagttttgactgatcaaaatggaagtgctatcttcgatgaattaccaggcagtaagaaacaaattgatgataatccacgaatcatggagactcaatttggtgaaagtttaggcctacgtaccaattccttgcgtaaaattttggctaacgagaccgctggccttgggtttcctgacttagtccacgttgcacattacgataaatcgcggaaggatgaagttggagagtatcattacattactggtatcgattgttcatctgaggctatgccgattggatacttaagtactctaaggctgagacaaaattgggctagtgagacaatttctacgttttgctgttataacttgttctccaaagttgatctaagaatcaaatttgagacggaaaaatctttccaggttagtgcaattgattgttctactgggaatctacatgtccccatgacagaaactctgtggaaggagacgttccttagtgggataatccgcgcattgattttcaacaaagatagagaatggaaattaccaggtatggttgaattaccaataggaatcgataacggtattgcatcagctcaatccattatcaaatcgttctgtgagtttattccaaggtataaggaaacagggttagatctaagccgaaacccaactgtttctcccttgcataactaccttgttgaatcgttgttatcctttcttgctgtgactccaaggttgcaccattactgtatctcaatcttagaagaattgactgaatctgatgccaagaatggtgtcttgtaccagatggtgaaatgtaaggttgcattccattccaacaattcagatctcttgacagcgtcatcgattaattcattgttgaacagttatttcaaaaatgtaaacaaactgaagaaatcgcaattgatcatgctaacagacttattaaatctacaaatcgaattcttgatgaagaaagaggattatgaactcgctttacccgtagctctttatgctacacaattggtgccagatagtttccagtcctggtactatctagccgattgttacatccataagaaggaatacgattctgccttgttggcgataaactcgatccccaagttgatgatcttggatccaagtaaagatgcctactggtccattggcttggataaactgtattacaagaaacctcaaggtcaaggtgcagaaagtacattgaattcgcacgaatacaactatgcgctaacgaagctaagacctgtcaaagaacgtgacatgaacgacatcacttttggtaagataataatgccagcaaatagctatggatgcattagaaatatttacgacacggcatgtgctcaaatcggaccagtatacggtcccagatccaccaatttgatagacttcgtttccaacgaagagatcggagcagtcgcatacactgcactactagaaagaaactctttgaagaacaagatcccatggtatatgggccaaatgtatcgcctcttgatgaaaattgtgaacttcctgggatggaatggactactggaattaagatcgtcaattttcgtcatggaatctgaacacgtcgattaccaaaacaagaccaacccattgttaagacaaaagagaatgtgtgagaaatggctagacactctgttcatggaagtgtaccaggatctaaaagtctcattgaactctccagcgctcaaggattccaagagcagtggcttagaatgggaactcttaggattactacttgtgaaaaccgcaaactggaatgaagccgtagcatgtctcagaactagtatcatggcgcgctttgacatcattgctgcagacacactactcgacctgtacctctttgggcctgagaacttcccgttgactactgacgaagtgctatcgatcttactgggaaactgttcataccattccagattttacgacacttgccagtggcttaacctacaagtcctatacaaactaaacgaagaactgggtacagaaacactaagaaacagaatatacgcacacccgctggcagaacgcggtatagttactctgatagacaaggcgctcgattggatccagcagtttgcataattgaatgactgactgtatcgtatatatatatatatatatatatatatatacttcatatcatgtatgtaaataaatgtatcaaataaagatcaaagtacagaataacagataaataaataggaattaataggaggaatacgacatataatgggtagagcacttctgttaccagtaagaatgctctcaccgaacatgagaatgatgagattgagtctcttgattgccattaccctccctctgttgccttgtaaaaagttttttactcccagtgaactatcgcagaggagctcacgaaaggaatttcgtaaattaaaaatattcagaatcaacaatttcaacttgaaatggtttgaatactggaatgggattgaacggaaagtgtggctaaaagagcgatagcagtatagatcggattgttttctgagtgtttcggtctagttgtcagagttatattacaaggctagctttggacaattgtgttaaagggtctgtgatatggtgacgcccccttaaatttacgttttcctttgtgtttgtatatttttgtttaaaacctgcgatttgtttgaaggtttaaacggcaggaaacgtttgctacagagacgctagtaaggtgatacacgttggttgtactgttggattctcggagtctttagtatccggaataataaaaattttgttcatctttcatttccattttaatttgtttactggttggttttaattctgattgattgttgaatcgatcaatcccttagcatatatccctttcatttcatcttttttcgtgttttaaatgtctggatccttttggaagttcgggcaggattatgccaatgaagcgccattgacgaagcttttgaataaggcgtttttcaagatcaataacaataatagtggttctgacgataatcacggacagaacgggtccggtgttgatagcgatgatgggttgaatctacgagagaagaaaaacatgtctgaacttacgtctgagtctgatagcgattgtatcagtggagaagacgattctggggatacaggtgacgatgacgatgtagaaaagaaggaggaagagcaggatgatgaggatgaagatgatagagcactggggcccgggacgacgaaaaggaatagtggacgtttcaatgatgaggacaacgagggaggagaagaacaggtttcaatttcagagagtaatttcgaatacaaggactatcgtcccaaccttgatattttagacgacttgttggatgacgaggaactgtatacagagcttatgtgctcgaatttcaaactattggtgtttttcaggtatcctgaagtgttagcaaggttggttgattatgtgaccaacgaacacgtattagaaccagctgacgatagcatggtcgatgaggaacaacaagaaggggaaaatgggtcggattcatccgataacgatgcagaggaagatcagggtaaacaaggttctccagaggcagaagcggattcaggggatgacttagagaattcagaagatgaaaataatactcaatcacaataccaaaatacactggacgtcgttccagataatgcatctgagtcttcagctgaaacgagtatcactctaccaccagaaagtgaagaacaggtagagtcaagaagagccaggatcgctgcagagattctctctgcggatgtgtggaccatttcctctgcattcatggataacgaagaccttctagtcaagttatggtccactttggaacaccctgctccactttcaatcattgcatccacatatttcatgaaaatcaatgaacgtttattagatatggacattagtggcatgataaacttcattttaaaacaagagaatatagttgatagatttattgcacacatcgataaccctccattgatggatttccttcttaaagtcatttctacggataaaccagatgctccaactggaataatcgcattattgaagaaacaacatttgatatctaaattgttagattatttatcaattgaacacgattcttcaattcaatctgctgcaggcgatttcttaaaagctttgattaccatcagtgcaaattcaaataacgaaatcgcatctgctataggtcctaatgagttgactagagaattagtttccgcagaaatggtttccaaattggttaatattatgttacaatgtggcacatcgttaagcaacggtgttgggatagtgatagaacttatcagaaagaacaattctgattacgatttcgtacaggtgatgtatacaacattggaaacacacccaccatctgatagagatccagtgtatttgggacatttggttagatgctttgcaaataagatggatagatttaacaagatccttttggaaacgaagcttgacccattggagacacctttcggaagcattgagccgttaggttttgaaagatttaagatttgcgaacttgttgctgaacttttacactgctcgaacatgggattgttaggtgaaccatcaggagaggctattgtacttgaacgagacttgaaaagagaagagattttgaaagaaatggaagaacagcttgagaatgaaaacgcatctgatgcagaaactggatattatgacggtgaagatgatactgctcatgctaataatcttcatagggaattacaagacctcaatataaatgcgacgctgaaagactctgaagctactgatgaagtagaggacgtcaaagatgttggagatgctggagatgttgatgcttccttggctgaaagaacagatatacattccgaaacttcatcagattctgaagttaccgaaaaagttctgagagaaaatccagttgttggtgatttattgaaaatttctttacaagataacaacatcattacaaccatacttgatatgtttttcaggttcccctggaacaatttcttgcataacgttgttttcgatattgtgcagcaaattttcaatggaccactgaagtctggatataacaaatttctcttggcagatctcttttcttctgctcatattaccgatgtcattatggaaggcgacaggaaatgtctagagtacgagaaagagactggaatcagacttggttacatgggtcatttaacattgatcgccgaggaagttgccaaattcgctgcctatatagaagaagccaatgtgactttcgcatcacctgtagtgcaagaaggactcaatgaacctaaatggaaagagtactgcgatacaattctcaccgaaacaagagaaaaatatagctctttactcggagatgacggtttcgacgaaggtgaaaacgacgagggcgatgacgagatttacgaagacgatgatgctataaatgaaaacgagaaaaggtttgtgaatgtgaacgggtccctggagtatgacgatgccgatgaggatgaaaatccgaatgaattaggtgccgacaactgtttcgtttatgaagacaacatgggtaataagacaaaaatccaagtacgactagacaacaacgatgagcatgactcgtcgtacggtggagatttgaataagtttagcaactacatgtcaaatcagattaaatccggcttaaacatggctgacaatgccgaggaagaagacgaaggagacgaagaggaagatatttggaatggtgaatcatccaacacattccaaccgcaagtccccaataaaaccttcttcaacagctccatgttccattcccaccaatttgatctgtcacctgacgatgaagaagattatttagatcctaacgacgatgggcaatcttatgcaaaaccaaaccatcctttatactccagcatgttatcaccgggtggtatgccctacgatgcaccagacgaagaactcaacgatcttgatgtaaacgacgatgatgaggacgacgacgaagatgatttcgatgctgatactgatgttggaacacatagcggcatttctcatcgttcgaatgaatactccctgcgtcgtacttccagtaatgataagatcccttacgatctcgctgagcagagtagtagagcaatgggaatgcctgctttgcaaagatcaagctcacatgatacagattaacaatgcagccttatccccaaacacgaatccttatcaacacaaattgatatataataaacatttacttttcctctgtttatcgttagttcaagtagtaataatattaataatagtaatagtaataataacatacgagtaacactaattcaaatcttaattctcatgtcatcaatacatactgcaatttgttaatttgggtattgttggatttctcttccttttcgtctcaatgcatcacttaattttatgaatctgaaaccatgaattcttgttattgacaaaaactggtctgtttagaaccgaactggatcttaataaattgaaccccgaagtccaaagagcccaccaatacactttcacacccaatggcatcatctaaggcttctatcttctccttccttcctctttacaacctactttctgcttctgcctgggcttatgtcctatatcaagtcgtgaccctttacccaaagatcggtcaaccaagtttctttattgctaccaaggatttagtcacgtacgttcaatgcggtgctataattgaagtcacaaattctttgtttggaatagtccgtgctccgctagtgaccactgctgctcaagtggcctctcgactcttggtagtcatcggtatcttccagtatgtgccggaagcagaaaatgcgcataaaatatattacatcacgttgttgtcggcatggtgtattgctgaaatagtgaggtacatgttctacttcttcaacttggtggctcaagcgcctactgtacttgttgtattgagatataacatgttttacgtgctatatccattgggcgtcggcagcgaattgttcataatttattctgcattgccgttggctgaagcaaaatacaatatcttgtacaagtatttcttaattgcaggtatgctagcctacattccagggttcccggtgctattctcacacatggttgcccaaagaaggaaggtcatgagatccttgaacggtgataaacgcaaatctgcatgaattgtcacaggattaaaagaatagtttgactcatgtataaaagttctgtaacatttgtaacatacccgaatgaatgcacaaatgaaacgacgctgtcccttggcgtggccgttggctcttccttctcatgactgtgtgtgtgccctacttttcacgtcacgtcacgtgactgacatcaacacttaactctcgaaggctcaaaaaattttctgttgaaacagtatacgactagttgaacaacatttaagacaagtgagaagaagcagattgaaagggctattgcatctgccaattgtcgttcgaatcagtgcagaaacgatgttcaagaatatcagtcatatgtttgccctcccagtaaggcaaatggtgggtttcagcccatttcttcaacctttgaagagaagtttcatcagaacaacacactcggtagcagaaaaagcgaaggtgaatttaacgccgttgaagttatccaatgagctatatgccgtattcagaatacacaacagaccatacttggtgacagaaggagataaggttatcttaccgtttaaactgaagcaagcagaggtcggcgatgtgctaaatttgactgatgtgactaccattggttctcgtaacttcaagctcgtggacgaacctattgatccatctctatacactattaaggctacagttcttgagaagacaaaacgcccgcttagagtgagagaagttaccaagagaagaaacaggaaagtgcgtcatgcggtcaataaagccgatttgactattctgagaatatccgagctaaaagtcaattaatgaactaaccctcctacaaaatcgtgtaaataaaagtttaatataatgttaggtcgttatagatcgattagaaatactataccatctagtaactatgttttagtggcagcatctcatcgaatttgttagaaacgtttaccgttttagagaatagatataaattcaaatagaaacaattgtaattaataccattttaatcgttaataaagaggggagaaagacgataagagaagagcttagtgcaacaattactgggtatcgatactttagtatctgataagtaaagtcccgctaaatatagatgaaccgtggatgatatgtctttcttgaagaagaagagtagcactgctggacattcaaggtcaggatctgcctcatctatactcaacaaacatgttgatcctgccaatatcagtgagttttatccatcgtcattggatcacaaggtgaccagtggtttgaagaacgattatagttttgattccagcagcaagggatccaggaagtcctctggtgggagcaccaattcgttaacatctgagcgactattattcaattgggatgtcactgatccgagccagtggacgatgcccaggataatacagtggttcagagctaacgatttcaacgatcagtggattacatttttcaagaggaatagtataagcgggaataagttcttgaaacttctagcttacgataattttgcaccatacgagaagtccttacaacagtccaagagttcaagttacgaaaggtttcagtacttattgaagaaaacgctggaagaaaacgtggtgaagggaaacaacaggaatggtaatcggattatcaataattcaaggtcgtcgagtgagtctgctaaggtcagccaaaggttatcgacatctttttctacccatataagaagtacatcagaatcggcgctgttgaatattgagaatattacgaaagacagttcttctagtgaacctaccacatcaaaaaagcaagaagcaagcaattacagtttacccttgaggcaggcaaagaccaatagcgcaagtgcattatatagacgaagcttgatcagcttacgaaatgcatcatctacgaaggataacgcatctaagaatgatatcaagataactatacccccaagacctctatctacgacagaaaatactaataaatcaccgacaacaccatcatctgttagtccctctcatacagcttataccggtattttcaggcgacaacataagaccagttcttcggaatcctccctgtttacttcgatttttggacatggtgtggttgaagagcctgaggaaactcctaaacccagaccagttgaaaatagaaggattcctgccgcatctacagtaaatgcatctacttcgaaacagtcgattaacgtagatgataaggctaggttgtgggataaaattaagcgaaagggacaattaccggcagaaccttcttctcagccagcagcaagaataatcatagaggaagttaaggaatcgccaaaggcggaaccaccagaaattgtgatacctgaagaaatatacccaaaacgaccctcagattcgagggaactcttcattatgttgacgaaagataattcaactttcagtccgttcaacgtccaacctcatcttggtacggatgtcagtgagctaaaaaaagctgtggctctagcacttgggttaacacattctaatttcagtattcatctgacagattttggagcggaatttggctctcagataccagacggtctattagctgactttcagaagacgtctttccaaaatattcctaacaaactctatatccaggacctagaaaagaaggctaatctgaatccaagaccaagaactgaaacactggctagtcaacattcgacggcagctagtacaaagagtaaaacatccgtgaaatcaaatgcaagtgctgcgagtaacggagaaggctcttcgtctgacttgacttcgatcgatgatcaaggctcttctcaccgtagagcttatccacaaacgcccagccactattatgataatagcacatcagctgaaacagactattggtcgttcaaggattctgtgccagagaccatatctgatgctcctcacattactttacccaaaagtaggcccagtcttaaactcaatagttctgttttgaatacacatgcttcagagaaaagtaccttccgaatcatcaggcagacaagtgatactgatattgatttcaataaaagacgtgaatctccctacgtaagagtggccgaattagcaccgaagagaaaggctccaaagccaccagtaaatggcaatccggttacatccgggtcgttgcctagcgcggctgctaaaaatgtttcagaatcgccattggaatcgccgccaaagttagatagaaatggaaagacaatatatcagaagaataaaccaagacctccacctcctctgacgacagaactcggctctagacgttctgtgtcgtcattaagcggccaggatctgaacgaggtaaaggagtcaccggttcaatcgtttactcctgcttcaacacaagttatggttcctcaaccatataaaggtgctttggaaacgttgaaacctcgtaaatctagcgcagatttatcaatcagaccgcggatgtctttaagacaattcagcaggtcaaattcctctctaaaccgaaaagtgctgtcaacttctcgacaaacactcaacaggaccaattctaaaccattagtcacctcatctacggctgcggatatctttgatgagaatgatatctcttttgctgatgcaccagagctttccgactcagacgactattctgcctcttctgacgaaataatatggtccagagataggaagtccatatcaaatgacgtacctgaatttagtttcaatactgaagataccattgatcttgtaggaactgatactacgcaagtgtctgtcggtgcaactgaaggttctgacacaccaaagaaaatggcattaagaccctctcctgatgttgtttatcagaacttggaaaaattctttccagatgctgatctagataatccaatccttgaaggattaacacccccaccttccccaaatgcagacagttcacctccaagccctagaggttttgaaaagtcattaaagacaaaatcagagcaacagccagcatttctttctagtcgtggtgaaagttctcagttcttgacccccgtcaaaagccttaaaccacctaagagaacaaagaccatcagaataattgcccaagaagcaagcgaggcgagaaaaaatgaggtgtctcagaaattgcaaagaaaaaatactaagatgtggggtaccaaagtcgtagaaataacggataaacgcacaatctcaattaacaaatccagaaactctaggggtgagtataaagagtttgcatggattaaaggtgaaattattggtaagggttctttcggtgcagtgtatctagctttgaacgttacaacaggagaaatgctcgcagtcaaacaagtgacagtacccgagtttagctctcaagatgaatcggcaataagtatggttgaagctttaaaatcagaagtatctactttaaaagacttaaatcacgtcaatattgtccaatatcttggttttgaagaaaaaaacgggatctatagtttgttcttggaatatgttgcaggtggctctgttgggtcgctgataagaatgtatggaaggtttgatgatcaactgataagacacctcactaaacaagttttggaaggattggcatatttgcattcaaaaggaatacttcatcgtgatatgaaagctgacaatttgctattagataatgacggtgtctgtaaaatcagtgattttggtatttcaaggaaatctaacaatatttattctaactcggatatgaccatgcgagggactgtgttttggatggcacctgaaatggtggacactgctcatggctacagtgcaaaggttgatatttggtccctaggatgtgtagttttggaaatgtttgctgggaaaaggccttggtctaattttgaagtagtcgctgctatgttccaaattggtaaatccaaaacagcaccaccaataccagatgatacgaaagatttagtttcacctgcagggcagagtttcttggatcagtgctttgaaatagatccagaaatgagaccaactgcagattctctagtgggccatccgttctgtaaaacaagttcgtctttcgatttccctaaaactaaattggcacaatttatcaaatcaaatgataagttgaacagcagtaggctgcgcataagctcgcaagagctgtagagcatgatcttttttaaatgatatataacgttaaatcactaacaaataatgctgatcaaaaaggactgaacttaatatttataacccaaagtgtactttacaaactaaattcaaaaaaataagctggtgcatctctcaaatacaatatcataatgatgttccatataccgctacatattgtacataaatcattcaacttcaggagtgttcatcaactcatcaatttcgatttctgctaaaagggaatctaatgttgcgtttatcatttcaataattttgtaagataaatacaaaggctgtctgagaggataccttaatggggaatcttctgagatccaaaacaaatgctggttcggttgcgatggtttactttccaaacgcaagtattgtacccattctgtgtacgtaaattcgtatgcttgatcttgatgtgataattgatcgatgtcttccaaatcatcaagcaattctttgatttctgctatcttcgagaaccttgtttccttacgtacactggttacaagagatggcagtgatttacatttgaggagcaaggtcttgctacctcgtctccttagttttgagctcgataaagaacagatgttgtcactaataactctctgttcataattttcaaattcctgttcatcaggtaatgtttcagattctgcagtttggtcaacggtagccatcgaggaagtcttgacaacaaactgttctcgtactttaccaacacaatattttgccattctatatagatttccaaggtggaaatactctagaatattgttatcaattgattttgatatctcatatatccagtcaccaacagttgatattaaaaccgtcattagaggtacagcgcctaaacaccaaatcacataaaatgctctcccacatccagatactggagagggcacaccgtatccaatagttagaaccgacaagagacagaagtaaaatgcctcgaaataggtccatgattcggagaaatataggactaaggctcctaacatgaggaataaagcgaaaagtgtaattgtcagaataattgaatttcgccgctgcaacattttggagcgttttctaatcgactgaatagtctcgtaagcatcatggtctgtaaattccaaagctgggtttgctaagtatttttgatagactttttctctttgaatttctacgctatagaagaagaatattggccctgatgaacttttcatggtgccactaatcatcacaacaatcaaaccaagaacaattaacccaaccaatgaatatattaagatcattacttctgaggctgtgttatctggaaatatgtcacctagtccaatggtcaacactgagacgacacagaaatacaaacttgcaccataagtttgaccgagcaattgagagaacatggcagcaccccataaaaaccatatagcaaacacaaaagtaaatttcatgagcaaccgttcattgtccaagagattgaaagtggcgggatatttttttttgtaatatccggatacatgtatcgattgaagtatcaagcataacaagtacaagcaagccgttatcacggcataccaataccctatagatctttgatagccatcttcaaagtaaatgagcgtggagatgagcaaagcaatcgttaaggttaattgagctataatccaacctgatatgcaaattatctgcgctttcacgtatgctagctttccagtgaagtttaaaaggagcacgaaatttgctataacaccactcactagggaaataatgttgagaactctaattcctggagggtcagaaacctggtgtccggtatgtggatcaattctccaatgatctactgcacatgccacggatatcatattggaaagcggtcctaaacatgctgtcactactgggaaatagcatgacactgcgaaccacacgataaaccatttagatgagggatctatagataaaatttcgagcctttcagctttgaaaccgacagattcagtcaaggctcgagttgataattcaaaattcgtagaaaaattccgagctgatgcatttctgctcctcgggatatgcataaatgcttataatttcaaatccgtaatgaaataaactttacctctagttatacccaacatatatcaaggtgtatcacaaacactgattacagaatcgtaactcggaatagcatcccattccagcttatcttactcgtaaatttacatagtttaactacatcatcgaacttcattaaggaatttagtagaatttaatgtaggatacttcaaaattgctgtgatgcatgggtgtgttgaagctggcaacgttaaagaaccatcgaattcgaaacgtaaataaagatcatcaagcaggaaaagtgacgcgtccgctgacgagacgactgaattgaaacattgaaggtagaaagagagcatctcttttaggtgtttgaccggtcgtaataggtggcttcattcaccaactgagaagaaaagagagaaactggtgactttgaatagaataaaagtttaattgcaaaggctcctctttatcagcatgtcattagctgcttcagatgtgtacctgtcgaatctcaacgatgcacaacgaaaggctgtcatatatgattatactaaagctcttcagattatagctggcccgggtactggtaagacgaaagtccttacagcacgatttgcataccttgtgctgagccagaagataaatgctgaagaaattatcatgactacttttacaagaaaggcggcggaagaaatgaaagagagattggtacctgtattggtttcaaacggaatatcacctcatggtttgaagataggaacattccatagtatatgctggaaattattgaaagaaaagggattcctaataggcaaagaaaagatagagagagcgacaacagagaaaattaagagtatattggaagagctaatagttgaaatgcctgatcaaataagagattatgcctgtaccaagtcatataagaatgaagttagtctatgcaggttgaaaaataatcaatggcaagtgcatccggatatgatactgaagcggattagtgagttgaaggctgacgcgataactccagagaaatatgaacaacaagcgattttcgatgaagcacttctacatttttatcagcaatatcaagcaaaactttccaaggaacatcttatagactttgacgatgtaatgttatactcgtttgaacttttatcgaaacatagagtgtggaaaaacatcaagcatgttcttgttgatgagtttcaagatacaaatttattacagatacatctaatattccagttcgcgagaggatcacatcatagctgtgaaggtgttactgttgtaggtgatcccgatcaaggtatatatgggttccgttcagcgctttcacataattttcaaacaatgatagaactttgtccaattgaatacgatcaaattgtgttgaaagaaaactatcgttccgcacaagcaattcttgatatctcggaaacagttattaagcagcaaaaaagtggtagggataacagagaaccacttcgagcgcagtttgttacggacaataaacctgtttacatgtcctttccctccgatgatacggaggcttacactatcacaaaagagattttatatctgaaggctattccaggtttgttcaagtacaaagattttgcaatattggtacgacttaaaagaagtttaaggacattcgaaaatgcattgattgctcacaagataccatatgtgattcagaaagggtacacgttttgggaactcaaggaatgcaaggcaatcattagatacatgagtatgatatgcaatgatgacgactgggaatccttaaagagaactatcaactatccaaacagaggtgttggtgaaactactgttgggaaaattgccgccgcttttgagaaggaatcaacagctgaaaagaatgaaaccgcttttagttttcttcaaaagattgcacgagattcagtgaagataaatattagtaacagctctatgattggtataaaagattacgttaatataatagaacaggtcagaaagtttttctcggagatatattccgatgccggtaagagtactattgctgacgccttcgaaaagttttacgttttaactggcttaagaggacaatacaaacctgaaaagaaatcaggctcgatagcttcagatgaccaaagtactgaaaaagaggcgcatcgccatttgaacgttctcaacgtcaagaattatttcagtaccttcaagattcccttgggtgatggtgatggggaaccgagaattgttgatttaattgggttttgccacgaattcgtcagcttcacagacttatacacattcaacgaggacaatgacaacgatgtcaaggatgatcatgaaacgaaagatgccgtggtcttatcgactattcatgcttccaaagggcttgaatggccagtggtttttgttccacaatgtgtagaggggttacttccaagttattataaagattcaagtgatatgccagcacctgatgaagacagcgatgaaaatatggctgtcggagatgcatacaatgaacctactgattcacaggatgacaatcgagatgggaagaatccaagctcacctacgaagaagaaatccaggactagtttcagtgaagagaggcggatgttttttgtggcattaactagagcaaaataccttctatatatcacaactgttgaaaaggaggctacgagcttcaaaagcagatttttgaagaacgaagttattgaactttgtgatgacaccttgaagtgttttgagagcatcgaacatttattcaaattgtattacacactgaaagttcagattcctaatcaagatcggatttcgtatgaccaattgatcaaggattattacaactatgggttcaacagtcgtcagctactattttggaaagacaacaagtattcacacgttgatcttccaaacatgacagaaaatacaatcggaatagttacgaaaaagaacgaaattgagtcagaactatgttctgcattacctagagtcaataaaactaacaccactcggaagacagttcatgtaagaccgggtgaactcatcataaaacaggaaagaggaacgcctccattatttaacagcccatcaaaactaagcccgaccccaaacatgtcccccactaagatgcctcccttaacaagggaagaaactagagagctggatgtacttctaagtgataacgaatttctgcctgaagctccttcccaagctcctccaataaaaagcgaatcggactacactgcggcggagattttacacaataaagatgagtcgataattgataatcgcccaattctcacaagtgccagaattcttgcatccgcaattaaacaggaactttcacaatctatccccaatattgatgcaccttccaccgaaacaccctctatcaaagaagaaaacgacactgctttcaaaggaaatgtccctaaaaaaccatcgacaaaatcaaataaaaagagggaacgtagacaacggaaagagcaacatcatcccagaccacagagctcttcagggtctgtcaagaaaacgaacaagatactttcaagaaaggtgaaattggaacctaaatccactaatgatattttactgaagctcgagaaagctaaacaacggaaagaagaatgggatggcgaaattatagacttgaggtcatcccaataataccattagataactagatacccgtaattatatagcatcttaaattcactcctcgtggattgacagataaaatttctacgttttgacacatttgacgcgtgttgatcttcattcgcgttctgatattattcaaaaagaaaccgtccctgataaaatgtaaacataaaagatatgcagttgaagtatctgttctctgacagataatcaaaggacacacatagattagttagacagtggtattcccccttacagtatacccatactgttgatttctgattccactttcgaagaattagaacaacatataatatctatctattcagtgttttgattgactgaagtaaaatggaggagctaacaaatggacttaacgaaaggcagcgacaagctgttacgcatagagaggatgacgtattacaggttttagcaggacctggtactgggaaaacaaaagttctgacagctcgttttgcttacctagttatagagaagaacatccatccattgagaataataatgacaacatttaccaggaaagcagcaaacgaaatcaaagagagactccagcccatcctctctcaggctggcatatcatccaatgggttattgattggtactttccattctatatgtgctagattgcttcgacaagcaggacatctaataggtatacccaagaattggtcaatcgccaagaccgaagatattaatacaatattaaagacattattagaggacacgccagttgaaattattcaatcgtcaacattcacgactgaattaagtgagaataggacaaatgtgagatttttgcggacaaagatctcagatttgaaagccaaaggtgtgacaccacaagcctacctgaaagaccagtcgcatgacagcgccatacagtacatatatgaacgatttcaagacactctcctttcagaagctctcttagattttgatgatattctcttgtattcaaagatcttgttgatgcaacgtagaatatggtcgttcgtgagacatgttctagttgatgaataccaagatacaaatgagctacagttagatttgatctatctcttagcaaggggaaagcatgataaatgtagcggaattacagtggtaggggacccagatcagtccatatatgcattccgatttgcctcttcagataatttcaataagctcattgaaagatgtccggttcagtctgctcagatatcgttaattgataattatcgatctgcacaaacgttgctagatttctcggagaaagtgattggccagcaaataaaaaataggatcaaaagggacccattgagagctcagttcaatcataacgtgaaaccattttactcatatttccagcggacggacacattcgaaaattctgagtccaattcccttgcccatgaaatattgtatttgaaatcacttcctggtttgttcaaattctctgatgttgcaatattgctgcgaacgagacgacaagtgtatgacatagaaaaagccctcatcaaaaatcgtattccctatcgaattgttaatgcaaagggagtttgggagaaaaaagagtctggtatctttctcgactacttgcgtattatttcccaggattcttgttcattagcaatccttagatgcttacaatttgcttccaatggcattgggtcaactactattagaaagatcaaatctgcttttgacaaagatcgctgcagaaattcactcgaggtcttgaaggagctttgtgagtctaacgacttaaacaaccaaaaaatctcagcagctttgaaacgttttattaatcttgtcgaaaaactaaagttaaagtgtgaagaatacgacacttacgatggattaaaggaactgtttgctgagatatatatgctaggcgagctatattcagtcctgaaaatctctaaagaaacaatcaatgaacagattaaagacaggtctttgaaggaatttcttcaaaccgaacatcaaaatatgtttaaggtatatgaactgtttacggagtacgaactagatcaaaacgacgaacatataatgattcaggaaaatgctgctgatcccaatgatttagctctgataaaggagaattttaactctaatgacctcaatttctttgaagttattactttctttaccaaatccatttcattatattcatctgaagaagagaacaccgaaaattctttagacaaattagcaaatcatctgcaagaacgagtaacagtatctaccattcatgctgccaagggtttggagtggccagttgtattcatcccttccataaacgagggattgattccttttacagagcagtcagctcgccaaaggctagaagatttggcagaattacgtcgggatggtgaagcatgcaatgatcttaataactgttcgatgggctcaggtgaattcgacaatattaaagaagagctacgaggcaaggaatcagacctcatagatgatttagagactaccttgaacgaagaaagaaggatcttctttgttgctctaaccagagcgaaggatcttttgtatttgtcttcttcaggcaaaaaaagcatcttcttaaagaactgtgaacaactctattcgaataatgtcttgttcaataacccacaatcaattttaaggttttaccgttgcatgaatcggacattggaagaaacctcctcaaagttttcattgaagtccctctgccaagactaccaaaagtccaaaaattgcaaaaccagcacttttatatggaatggtacaaatgttcaaacacctgctttaatcgatttcaataacaatactgctccctcaagtttttccacaggaaccaatagtttcaaacctgcaagttcctttttgaacgcatcattctcgccaggtaaaaacagctacaattctgggactgcaaatgttaccaaagtcctcacaacctcatctaaagaatgtccaaaacctgctggagggaaaatctgcgagaaaaagaggaggatcaccctggatatgctgtgcaagaagcctgtcaaaaatagccaaagcatgcaatcaaagaaaatcagattggaaagctcctccgctcaagacttgtcgcactctatatcttcagataaaagaactaaccactcaaccaaagtggcagtaagtcaaagcaaatcttttgctccagcgtacactcctgtcaggaacaacgcgaaacgagtgaaactcaaaacgagtactactgcaaatgcctacatttcaaagtaaaagtgttttaaatgtatatttatctaatgtctttgatgatgatctgcgatttaattacctacacagaggtcaatacagagtttcttaaaatttaagcttaaacggaacttttagagcgaatacggcgaggaacaaagcatacactgtcagtatcgccatcgccttataaggtggtgaatccaatgtgttgaaagtgaagttaaccatccctgttgtgacatttgatataagaaataccagcatgccgttaccgtttacagctcgatacgtcttaggcactctaggtttgctcgttaagcattcgactatcagttgatcgaaggttaagattaacagattgaatgaaataaccatagaggagtacccaattgaggcaaatctccgagatacctgtaatggatgatagtgtagaagaacatacgatatggcagaactgaagatgcttagagctaccaatttccacagcagttgcattggatttctggagattgggaagaacatactaccaacttgctggccagctaggtagatgatacaataaccaacaaacgaaaagattccttctctattcgcagaaataaaatctattcgttctgcatttaacaaatagtccagaaaggttggatggtatatcaggcaaagctcgtagataatggctgcaatcaaacctataacaaatctcaatctcatgttgtagaaatcgaaaataatcattgcaaggggtagtaatgaaagggtaaagaagaagttccaatggataccatattcggttgcatgttcttgatagtttacagccttaacggaaaacaaacgaatgaaacccaataccactagtaccaccgtcgaccttaatgattgtttaattttagcccatttggataattcagttccagattttaatcttttgtaacttataataccattgctgaatacaaacgatccaacacctagatccatcaatgaaatgccccaggtttctaccttggcatatttcctaggaaagatagggaaatctacagccaatatggcaatggaagttaagatcagcattgtactcctatacactgtgagggttgctgactggttgccattgtccattacagtttctttaatcgtttcgcgtttacttcccttagatatacatccaaataatagcaccgcacttaaacctaatatacctgtaagaaatgggttttccccaaatacagtaacactacagaggagacccatccaattcaataagaaatctaaccagaaggagtcccggtagctgggattgttcgaaacgacgtagatccaagcggcgttagaaaaaataccggctaatgtgacatctcgtaaatctgcaattgaacttccggagtgtccggtaacgaaagcttccttccggtgtttcaattcatcaattacaccagaagcatccatggtctgatatccccgagcctgtatacgtttcttgtacttacttcctttattgaaccttcattgatctagagcttaataaacaggtagaatgacacttgtcaatattttcacttttaaaggaagcatgcacagaagagtaaatctggaatataggttcagacacgtaaaaatgacacacatttaggagttagaggcacttctaagcagaataagaatgttaatgatcttgttacagataatatccgaatggatatgtatacatatatacatacatatatatggcgtgacgtaataatacatgagatttatgaaacatgagaaatgatgtctttagcttggcttctggtagaaatcttccttcttttcaaattctgctgcacagatgtcgacgttgatgctgatccgtacgtgatctgagtatgcgaaagatggtcactatcatgacctacagtttggataaagcttgattcctcattctctgtatctacattatttgaaagaagtttcccccaacggttccctctatttggaacatgaggtagttctgctgatgcagaagaggcagttgacagaggtgccgcaatatcaacaggagcgggtttctctagcaaaggatcctcgtttcctctttcctttggaattatttgtagtgcaaagtcagatttagaacccttgggacaagaaatacaccaattaacgtcattaaagtagatgttcatggaagtcttattaggtttcattgctctttggaagagttcaatgacaaaacttggagttaggatgggaatatgatgagcttgcttaacgaattcaattttccgtttcattgaatttctaaacatttgagcttgatttacagagatcttcatatccaaatctgtcctgaacattgacgcgtacttattttgccttaaagtatgttcctgtggtattgaagtcaattgggagatgttaacgagtaagaaatccgtcttcttcgtcaatttctcatgatggtcaaaaccaatcaacttcaaaaagtctataattttattgatgtgtagtaattccacgccatggaaccctgtgatatggaaggaaagtttagggccatgtaacaccgatttaggtggaatgatattgaaatcgttgtagaaaggttttgaccaaaaatccggaggtaggagttgttcgtaatacaaacatcgttcgatgaagaattctgtcaaccacgatgattcatttgggattctcggcagtagatttgccggaaatccacttggacagatataataaatggtcttatccttcagctgtgccggtgacggtgatgtatcctcgaagagggaagacgttcctttattaccgcgaatgacattagataagatagtaacctgtcttttttcgaacttgaatagcacgaagtgacagtccaggaaggtcggtgtatcctttgtctcaccaaggcattcttgatgcgttggggtggcttccttaatatcagtggactttgacgctgaagcatcaccatctcttgccaatagtttcccccatatctgattcgcttgaggcttaaatttatctatagcaatcttcaacggattcaccgaatcatcttgtacacccatgggatttggttcagttacagattttttcttatctggaacgtcacgaatgtacgaaccagaaccaatgtcagagtattcaagttcatgacaatttttcaacaggtagaaagattgaaagtctagagtccctgatctgtccatacaatcaatgatccattttggatgcactacgggaacgttctcttctaaagcagcctggacacggttccccgataaatcatcggtaataaacaacgaaatgcatgcattggatgacgaagagttcctaatgaaatgcgtggtatctaccgatttcactttacccaatttacacaactgaaccaacgactcaagagaataatggttattaggtcgtattctgccaatgaacaagttaaatttttcaaacgacccgatagagtacttcgattttaagtactgggacatatcgaatttagccaactgcaacagatcttctcctgcgagccacgcatcgtacaactgatcaacggatcccggactaacaaacacgatatcagttctattcttgacagcaaagttatactttgcggtgaataactctccaacaaccaatacgttgactagtcttgtcaaatccttggtataagtcccaccgagttttgtcactttatgtgagatggtatcagaaaccgacaacgggagagacgtaggacagaacaccagtccttgaaatggtttgccggacatgtttgctctacttcagggagaattgaggaagaagaagaagaagaagaagaagctatctacacctttgttccagctttttagacacatcatcaccattcatatgtgaaggaaggaaggatggattggatatctgtgtaaatacgcgtttatgtgtggaaaataataaacagagaagagttgtaaaatgacatttgtttacaggtcacgtggacgaaaaacacaagctacccagggttaccctgagaaaacgaaaaccaaaaccaaaaattaaacactaaccacgtgactacagcgaatctcccccttccggcgccccccccgtcgagtcatcatccttgtcagcaaccgtccagctgactcatatatctgtcacatgtgaaattgcaagaagcaggcaaacatcgccacccatacaccattcggacttgtgacttctccccgttagcctttcatccggacaaatcctttcaggtccttactctccctacgataaaccgatataactgcacaaatttttttgctgactacacggaaaaccgcgcctagaaccgctttttttgtccccaaaacttcctttccccagatccggctgaaagggacaattgcaaaactggaattacacactactaacgcatattaattagccctcttatatagtctatagcataccgaatactgaataatatgtccaacgtcacttgtggaaatgtcacaaatgtcagtttctgggatccatcaattaagggaaattcttcaaacgtcccagctatctcggttatctcattggtttattctcttggcttgttaaaaggtagtttcttcttgccttagtttcttgaattagatttctcgagggtttttatagccaaatattattattattattcatgattctgaatcagatatataagacaaacggacctggggaaacgttctgccatataaccatgaaccggaaggtttatggtaggtatcagatgtttttttttctgtttggaacgtaagcttgctataagcttcctgtagtagcgccaagtatatgtatatatcactatgccaagtgtttcgcaggatgatgtaaagggcgtgcttgctggtaagatgtctactggtaatagcagtgatgacagtagcagtcagtcaggtaagaagcgtaaatatgggaaagtcgacaaacacaatgagaagaaattgttgatgcctacggcatcaacaaaagtgaaacggttttcacaggcatgtgatagatgtaggcttaagaagattaaatgtgacggtatcaagcctagttgttccaattgtaagaagatagggtaccattgttcgactagtgataagcttacaagacgcgggttccctaggggttacacggagatgttggagaacgaggtgattaagttgcagcggctttgtgggatggtggacgagaacggtgagaccgtgattgatggtgcagtagctgccgtggcagctactgcacagacgggtgttattcctgctggccaggaattccttaactctgtgggggaaatgggaacaaagtcttctgtttcggttcctccagcggcatcggcagcgccagtaccggcccaggcccctgcgtccacgttcctaccctttatcaatgatactttccataaattcccaaactatatccatgaccaagtgtatctaggtaatttcacctggaattcgatcgtcaaccataataaatctcagttgaagtctttccagtatacaaggtctatcgtacaggacccggttctatcgtaccttaaccgacatttcccactttcaccgagcggtgtaccgattaatatccccttatctgctgaggatgtaatacgattaattgataagtacttgaactcgaaccaaatcttcccatatctcttggggacgtcatggcaccaacgaatgatctcggtactaaccgggacttcgactgtctctgaccctgcggtgtccattgtactaatacttatagtacagttcgagttgaattgtttcaataacgagacgattttccaggcggttaaacttttgggttccttgtcgcaggacaaattatcatcgattcaactgatgaatttcggaatacggtatttcatgtcccaggagaacccatactctgtcatttggactaacgatttgattaatttcaaccagtatatgatcatcaattcagctttgttcttgaattacaacaatcttgttggacatgaaaactcaacgtcaaaggttattaggcttctcacgttttatcaattccaagtgttccagatctggtggtgtttcatcaacggattacctaagactaatttcttaatcgatgaattccatccaccaaccatttcagagttcccacctcatttgaagatgttccaactcatttatgatttcatattgcaattggatggttgtcaccttcaattattagctaatgagactaacaataaatatcagctgttgatagaatccttcggttacaaattaatttaccaatggaaactttatcaccatttacaagaccatgatttcaaacaaattcaattggaaaacaacgacttacttgaaatcggtatcactttggtatacctcgtatgccgatatttacaacaaccgaattccgtggaactatcttatgaaatcatatcactttattggttaatcctatccgataattcaaacgtgaaaccaataaattcgagaatcttgaagactgttcagtttatgcctttgaacaataaacaattgatagagaactgtttgttgaacttattgaatgaaccaaaggaaacgttcaactggtacaaatacaagaagttgttgaaacgatgggtcaccatttggatggatgataacgacattttctcaaggttaatctctcactaccaactctccatcggcatgtcagatatttcaccaaccatttcgaatttcaaaccaatggggatggtacctgataccgttaacgacacaactaatttattcaagatatatgacgatgccaatgataacataattgatgacgaaggctacgaagaagataacgaaagtgactacaacgaattgataatattgcccaagaggcgaagcatgggtcaccatccatctgcaagagcgtccagcatccataaagccggagatcgaactgatttttcacttttcaacaataagatcgaccacatcataatcaaggagtagctactcaaatcaaacagaaaaattcagacagaagaatcaacatccgcaatatccataactatttattactgattactactaagtgtcatctcctcttcagtcctttcatgataattattactatatttattctgttcactagacactattctttacttctcccattaaatatacttataatgttttatcagttaatattcatatataccattaaaatacaaggtgaaaagcataacaaagggaatagaaaaagagacagaacaatacataacaagacagagaggtatatagagattatttccgttccacccaatactgctgtctcatcatggtaaagatcaagttgcctgatttagagagcgatgaagacgtagatctgataggaacctcgatcaacaaagctgcaacatcaatctctgacgaagagaccgaggagcagctggccaaaccgttaaagttcaagttgaaaagaaacaaacaggtaccactagtagaggaatataccaatgatgatgattactccacgttgtttgagcaacccgccggaacaaaaccccgtaatacaaaggaaacgattaacgtattgaatttagaagatttagaaggttcagaggaagaacaaaatgaaccacctaagtacaccaagaaagtacaaaaccgcagccagctagtttcagagaagaaagttaacgaaaagacgtacgtgaagttgctcagcaatcaggataaagacgatttacgtgaattgggaataaccgcccaggctgatatttacgctgaagaagacgatcaactattgatggataactcactgcaagacgaacggttagcattgggagacaaagaaaaacagctgatgcaacaacggaaacgtaaagagattgaacaattgataagtttgcatgatgaagagaccgttttaccacaggaaatacaagaacttgataaaataagcggtcaaaagacagttcttctacccagattgcaacccgagcaaaaatgggaagatatatatcaagagttgagcgaatacgctgcttctcaacgtgacagagacactctaagctccaagagaatcgaaatattatcacagcaattgcaagatttgacgttgaagaaggaaacctttctagaagagatgaaacagatagcatcgtcacataacaacaaacatcccacgtgaccaaacacgaatcacgtgatgctaaattgtgactcaccatataaggtatgacgcatagtttgggaaagagcccattcgtacagaatgactgcatggtatataacgaacagcacgaaaacggcaatttctcattcagaacagaaaaaagttaataaaaaaagacagtttgaccaattcttaccgttaagtacaactgataacgaactaacagttttagattctacaaaacttgcaagtatctacacgcatttgacagctgctttcacctcaaccgactgatttttaggtacccgaaggctgcatacagaattttttactccagatttactagctatgactataatgagcgctgcttcttcctcttcttctggtgatattcgtcatttgatttcgatcaaggatttgagcgatgatgagttcaagagcttggtcgatagagccgagtattacaagaaggtgttcaagagtaatgatatttcagaattccaaaaacaacatttgaagttgttgggtaagaccatcgctttaattttcaccaagagatctactagaaccagaatttccacagaaggtgcggccgcattcttcggtggtcaaccaatgttcttggggaaagatgatatccaattaggtgttaatgaatcattctatgatacaactaaggttgtgtcttccatggtttcatgtatctttgcccgtgtcaatagacatgctgacattttgaacttggccaaggattcttctgtgccaattatcaatgctctttgtgacaagttccatcctttgcaggccatttgtgatatgttgaccattaaggaacatttggactacgataacaataaattgaagatggcttgggttggtgatgccaacaatgtgattaacgatatggctattgctgctttgaaactggggatcgatgtcgccgtagccactcctccaggtattgaattggacagcgacatccaacaagagggtcaaaaattagctgctcagaacaactgtgagtttgtctgcactcatgattcgatggctgcttgtacagacgctaatatcttggtgacagacacttttgtttccatgggtgaagaattcgctaaggaagctaaattaagacaatttgctgggttccaaattaattcagaactatgttctgttgctgcaccaaactataaattcatgcattgtttaccaagacaccaggaagaagttacggaagaagtcttctacggtaaaaactccattgttttcgaagaagcagaaaatagactatatgcagccatggccgctattgacatatttgtgaaccacaagggtgacttcttctcacatccataatttcattcggatagaagtacctcctttcccatcgtttctccatcaatgtttatatttgggaaacgttaatgatatatactctcttatataaatcggttgtatcccggtagcttggaagttacctgcatagtcatattataatgttataaattaatacagactttcccgctaaactgaaggttgtcagttgtccctagactgatcatacctgtatcagtatccgattcttgtataccgaactcatacacttctttagccaattcaccagaatacttcgctgttttctcattggaaaacaatgcaagtgttatgtgaggaactttgttaaggcaagtcaaatggtccaaatgagtaccatctggcataacaattggatgggtatcatctagcagggaaacggtagctagaattacgtgcttatcccagattaaatctctcaatttgaaagagacactatcctccgtagcgataatgtttttggtagcctctgagttattttcttttgagagatactctttgtatctatccaagtatttggcccacatttgtttagcttttataccaacagacctgatttgagacttatggtatagggttatatgcaaagcgtctttgaaaggagttgaatccagacttttaagcaaagaagggtactctgatgcatgtgtttcaatggtttttctgacatgttgcaataaaaggtctgtgtcaattacattagctgagaaatatacaggtttatgctgctttttgtcaattttattcccacctttaatgattttcgttatggttggtttgtaattgagagccctttcaaaagcctgatgtacgatagaatcatctgggatcgagggaataacgtctccataattacgctgtaactctttgagaacggtaatagtgtttttcaacgacgagttcttgccaacttccaattgtatatggaagtcaaatttgttatcaggatctttggaaggaaggaatggttggaatctgttcatgaatccttgcataattttcaaaaccttctgctgatcgtcactttcagatttgatgctttgatgattgtcacctcttttcataaccctgtcgatggttaatgctctcatttctggggatacctcgtctacaaaacacaatgctatgacttgtaaattacagttgtatggaatatacgaatccctatattgattgatccattcaaaaacagctgccctttcacggaactgatgattgtttttatcagcaagcacaaattgtttcccgtctttgaataattgcaaggctgatttaatgtagtctgttttattagaggttatattgtcgttcacaactagtccccatgactcagggaataactcattaagcgtgagagaaactgtagatttaccacatccgattgtagcaattgtcactagtaaaaattttgtattttcatcgattacattttcgacatgattttctgcctcttctaattctttaatcttgtccaaattgaggatctctaggcctgacataccgtaatcttctagaaagagttttctcaattttattatacccttcccgttcatgaaatcatcagctagttttgggtcacgatccaacaagggaatcacaaagtccatatatttgttggtgatatagttatgcgagcggtatctgaagacacgttgtttggtagatatgtactctcttgtaacctccctccattgtcgatacatcaaataaggttctttaaacttgtacttgaaaaagaatgtcccaccagttgatttatccttacatcttatcacaaacccttcaatctcttgattattgtaatgaccagctttttcgcactcagtaaggaatgtcttcaatgatgaactatcttccgtagtaaagtaatcaatatgcttaaatccccatgcgtttgcaaattcagctacttttgccattggaaaagtgctgaaccctacagtattgtagtttaaaccatgtaggtatagacctgcattgtctctgttatattccaaaatatgttcttcaaaggtatcatcgcaatattctgcaatagcagtacaattggcttcatataaataccgtccaagatccttcaatccaaggtttttctccttcaattgttgttccaagaactgctgaccagcttgtgaatggtttctgttgatgtcatctctgggcccagtgctatgtttcgaacatactacaacagtaccatcttccaatcctccaatcaaaattatacatccgttctctttgacagtaatctcatatggcccctcagtgttatcttgaattgacctccagctagttctttgcacttcgtcgatgttaaagaacttatcgtatcctctagtaactatcctgggctctgaatcagcattttggataaataaacctctggcactacaaggtaacactcttttagatttgccatagtcccattcattgaatttccaactgtccaacttcacatcgggtctatcaaatatagaacatgtgatcttagtagctttaccatgcttcttcaaatgagaagcttcttcgagtcttttcacaagctctgtcacatcttgttctgccatttttgaagccaaataataaagctaatgctttcaggcttcctgctagaaatctcgtcgaacagcttggtcgatatgaatgagaagtggacagatttaagcgaaatttcatcgatatatcataactcatcttgtcaagtgaaatctcgatttcaatcttcgaaatcgagctacgttacccggaattggtgaacctgttgaagttcactggatctttataaggtgaagcctagcttctctgtaaatgtatgtaaataagataaaacgaagtattgtgaagggcaagcactgtgggaaagaacgatcctggtcatagcaaattagcgtatatcatcaattcagtttacttctcctcaatttacccagagctagctaaaaaatagcaaaagttttacactattttgcattgaataaaaccaatagggtttgtgcgaaagagaaaggaagccaaacgggaaaacaggaaaggaaaggaacaataatgtcttctattgatataaatgaagcagacgttattgtcctttcagaaggtcttaagaaattagactcgttgtatagtgagatgagtcaatcattgaagaagatcagttctactacctcaactgcttctcaattatttacacctatactcaagaagaaccaacaattgaatattctacaatacaatatagagtccagtttgaattccgtagcttcagtgaaggatctcgccaacgatgcttccaagcatgagattattttggaacaatcaattgcaaaagttggtttgaaaccttatatcaatgcgatccacaagatagacgatatcttggaagacctcaatgagagaacacactcaaatgatacttctgaatttgcaggtatggttacacatctgaaagaattgattttcgatggtgagaggaatttacagatctatttcaacaaattactgaactcgatccagccattcgatccgcaaattaatatgaataaaaaaataccattcccatactatgatgacgaatatttgggacaaatgtcgcttatattggattatttcgagaattcaactcaaaacgcacaaatagtggatctttttatcaaacagcgggtccgtttgatatcacaatcattggctttcttagaacctttcacgaaacaaatatcatctggacctaatgtaccataccaaaaggggagtagtggtgtaaacagttacaccgaggcgatgctaggcttcattgctaacgaaaactctttgattcaagatttatattctaaagaaacttcaaggcaacctgtgatatatgccaaactttgttcccccatcattcaaaattacttgaagatcataaggcacaatagacaactattgaaggataatagagaaaacatagggttgttctcatttgaattgagtgacaaagtcaacgatgttctacgatctctaagaggtaaagatattgccgaagcggattatttgaatagtgagttgatagaaattcaaaggatatcacattcgttatttcaagagttattcgcatatattaatacaaaaacgcgcagcatgtctcaattaccatctgataatggtgtccctgaaccaactgtggatataatgtcgaaaataagaaagtttagtgaatataagtcagggtgcctgtctaccatccaggccatgtcacgttcgcagtggttaccaaaggatccaaaaatttcttggacaattaccaaaaaccaactggaagatctttcaagtgctaatcttttatcttccttctttggtgacgccattgactatctcttattcggacttgaacgtagagctcaagaaactttgaacccacaacatgaaatacatttattgtcaaataaaaggttccctaatatccaaagaatcgggtttttccttttgaataacctaagcttgatcgatcagattgttcaaaggtctgaaataaactctatcctaggaagtgctgggctagcacgacttgaaagtttaagaaaaaaatacattaattactatgtctcggattggagagatctcacctctattcttttggatcaaatatttgttgatagctctggtaaagtttcatcaaaagaaaaggatcaaatcaaagaaaagttcaagaagtttcatgatggattcgaagacttggtatccagatcaaaatcgtaccgtatttctgatccagctctaaaaaaaatattgagacaagagatcctttcgttggtactccctatgtatgaacgtttctacaaccgttataaggactcctttaaacatcccagaaaacacatcaaatatactccctctgagttgatgaacgttcttaatactatcattaaataagaactacatatttaataaatctttgtctatagaatctgatatgtttgttggttcaggagattcacgctgattatacctttctaggttattcttgaaatcctccaaagcatgattggactgcaaaacattcatcgaatatgattgtgaaagcaatggagacatcgctggttcactttgcagtgggtgccaagatgtgcgctctttgcctatcattgcagttaggtccatggacgctttactctcttggtcatcttccgttgttacttgacgaagtagaagcggctgagtggaaatcgaattagtgtgtgattgtgatggttccaacttctgaattgtgtctgcagatgaatgagaaaatacatcatcctgttcattaccttcgccagctccattactttcattaggcccatttctttcatcattaccagctgctgaaagaacgtgctccaagtcgttgaatgattcgcttgagtttttgatagtagatggtagagaatcaggaacgataatgctactgcgtctcctcccagaaacagatgatttacgagaaactgctgtcctatcattgtgtgagtgggatctcatcattgcagtcggaagatttaaagatccgctatcatttccattgaagtggaaccctgcagcaatgtcttcatctaccaaatctgtagtattggaaaggcatatttcaggaaccaccaccgatgaagcctcgctgctagcttttgactttgtcgtcttaccatcagttgcaactgactccgaatatgtaggtggatcgacaggtagagactctgctttaagagcttcttgaaatggtggaagctcatcgtccagagacactgcatctatggtttgattttgtgcgagcgatattggtttccaagtgggagatgaaattggagataaaggtaatgcctgaggtgaagccaattcagcatgaatatgctcaggctggtaaatattagaggataattctggagactgcaacactttattccttaaattcagttccgatattgataattcgctatggcttagatttctgtgctgcagtaaactcagactggttctgttgtgggccacaggacttaacgaaacaggtgataatccaattttctcatctaatggttgaacttccggagacataactggtgagttaatgacttgttttgggaaatatagattcgaatcatgatacatattaaaatcagaatcaccgaatggtacagagccactgtggggaatagcggcatgagtatcgtagcttggaagcaatgtatttgcgtgagaagaaagcttattcaagacatgaataggtgaatcaatacttatttcgaagtgttttttgacgccatcaacattcttcgacaatctcaaactaattttaatccaatgatttgatttgatggtcccatatgaagtgtccggatgaatcttttgttggtaattaagcctttctgggaaaaatacctgatatttgaagtccctagttaccaaatcaccatgttcatcttctaataaatttcccaaatatttagctttagtaggtaccgcatctggtggtaaatcttttatgggaggagctctatgctccgtgagtaggaattttttagttggttcaagcctgtgaactttcttgcctttacaatagtactctaatgtctcagtcaagaatattcttattctgtgtagcgcgactttatccataggcataattcgaaatgcaattggtagaaatgcatcaagcacaatgtctttggaaacaatcatgatatcataatgtaaatgagtattccagtctctggaaattgcaataggttcagtttcttctactgagttatcggatggtgtccttacaattgtaataggtagcttagcgtttacacctgacttgaaagcaccttgacgttcgatattcacaagcaaaaaatactcaacttgaccgaacgtagcagttatagtctctggatacgataatggaatagcatgctcaaaggaaaaaatataatcacctggatgaaatatgaagggaccaggagttgctgaagacgagtttccgttagacttcaccgatgaaatatcactaacagaattggaaatagaaagcatgtcgcaaaaggtttcagataccatcttgacatttggaatgtcctttgaagtagatcttaaaaaattccctattggagaaagagaccgcatctgtgcattactatgcctcctggccattggtttatccatatcatcgtgcaaaggcctgaataacgaagcgttactccctttcagtaaatcagcaggctctgttgactggttatttggaacactttgcaaatcgctttggaaaaaaggccacgtatgtttcacaacatcattgagctctacaaattcttgcttctttggtggaataccttcaggccattctgtctttgacgtacctttgaacgttaaattaatagatttcaattttgtagattttaagactcgaagaatcaacgatcctcttagtatagcaggtggtcttccctcccaatgagtcggactaaacccttgcaaaaagattataggctcagcaagttgaatgtatacttggaaagaacttgatttcgctaaaggagtagcgtccttcggtattcccaaatgaatatccgaaggaaacactggtgacattaccggactcaggtcaaaagacatcttttgatttcagttcagaaccagaaactacggtcagctattacctagggagttggaaagaaaatagagtctcccctttgagttgcgctttttcgaaaacaattgttcgatttaaactgaaaaaccctcgaaaagattagaataaacaagtaataaatttgaagatgactttcttctggcttaaatcctgtacctgcaacctgcaataaactagacaaccgtacttagacccttgaaactctgatggcacttaccaacgacctccctacagctgataaaaaggtatgttgccttttggagagcagacattcttgaaaggacatatttaagactgaaagcttttctttttgatattgaaaagcttaaattggaacctaggaaaaggaaccgattttgtgtagtatgccaaggaaaataacgaacagttatagagtcacagttgaaccaggttacggggttgatttcaatgcaaagaaggttcgactctatttctagttttcatctttaagtgctagttttgctcagtttaataacggttttcttttcatgaatgaacgacggaagattatcaagagaatactttgatttgattaaggatgcacttcaagaggaggaaaaaactggcggaagcggtagcagttcacctcgtaagagacgcaaattaaggtctttgcagaaggaaccagaattggaatcggagagcaatcgtgtcgttattaccatcgaatcggacgatgaagaacagaataactacgatgatgatgatgatgatgatgatgatgatgatgaatatgatagtgaagagttcgaagatgtcactgatgcgcctgctaacaatggaaatatatcaattactatagatacatcagctcagaaaaagtctacgaagaagaagaagaaaactgagcatgggttagaccctgcagtgaaagaatttcgtaaaacatgtcatatgttcatgctacttactctcgtgtgccactcatatcagaggaacgaatggtgtaacgacgagaagttgcagaaaaagcttgctaaactggtgtctgacgatatattcaataatctacatccccaaaaggatgatgagatgccattaagaagtacccggaagttgctcgatgcattacgtatgttgatgaaacattggaacaaaaagttcaaattagaactaacttcaccgtacgaattcaatcatttatatatggttcattgggattcggtgttgaagcacaagtgtgaaagtgtcacattcaaaacattcaaaaagtttttcacaaggatgcgtggaccagccaatattagtgtgcagggttttgtcaccatgctgagaggttgtggattgaacgcaagactcattcatagccttcaaccacccgatttcactgatagtaagatctacaataagcgagttgtttggagcttggaaaatgaatgcctaaagtatccgatattttggtgcgaagtatgggataaatttgcgaaacaatggatcactatcgatatcgttggtcaagaaataattgaacaagtgcgttataaatcaaaactagaaccaataggtcgtataaattcagccttcaatatgatgcgatatgtcatcgctttcgatagaaaacaaggctgcaaagatgtatctcggagatacatagcacatttacaaaataaagttcgaaaaaagaggattacaagagaagctaaactgaacgaatggtttaacagcattataaagtttttgaataaacgtaataggaacaggattgatgattatgaggatgaatattttgatttgcgtaatgaacacgagggaatcccagacagcctacaagacattaagaatcatccgttctacgtcttagagaaagatttgagagcaaaccaggtattgaaaccgggtgctcagcagtgcggcttccttcgacttcgtaataaatcaaactcccttctcaaagtttttccaaggaaagatgtaatatcttgttacagtgctaggcactggtacatgcaaggaagagcattgaagtcgggtgccaagcatcttttgacacacaaaataaagaatcctgtcgaagaagacgaagatgaagagaggctttaccccattggtcagactgagtatgttattcctaagcaagtggatgctgatggtaaaatccctactaatttctacggtaatattgacatttataaaccatggatgattccaatagggtgttgtctcgtagaaaatccaaactcgattaaagctgcaagcttcttacgtgttccatttgcaaaagcagtgacgggtttcaagttcgaatcgggacgaagagttaaacctaaggtcaccggcgttgttgtcgagaatgaatacgtcgacgcattggttgctgtaatagaaaatatcgaagaatgtaacgatgatgcagctagacatgaattagagcttgaggctttgaacggctggtcactccttcttaccaaactcaggatcaaaagtagattggttgaagaacatggtgcggtggcagatgaagacggcagagattactctggtgaaagagatagcgatctagaagatcacgaatcatatacgggagaagacacagaaatgggcggtttcgaacaaggtgggttccttcttgattctaatatggatggtggattcgtgcctgaaccagaattacaacatgcagaatctgaaacagaacaagttgaacatccacctgtgacctatggtgaagcaactctagaccgcgctgaaccaagtaacacggagccaaacgaaatcgctgatgagttcgaacagttcttgcaagaagttggatcgcaatcggatgacgatgattcatttcaatatgaatcagaataaatctcaagatcacgtgaactattagtgtagcgtatctaatgactatgtaataatatggaaacaatacataacataaaataagcatcatgatggaagttgatgtaccagtggatcaaaagcaatcatcgcacaagactgtattgttaaccgctgctacggtgcagtgagtatacattaatcgatattctatctaccagtactcctgctctcttcaaagatatagcaaaataatgagcttcttggctaagttacagcagttgaagcagaccactaagattaatgaaccgaatcattccgcaaaccaaaataaagctaaatctcttcaatctgaagaaaaactacttcccaaggattacgttcgtgaagttgacccggctattcaaagattaaaggaagcgcgtaggttgaagcaaggtatatcatccacatcgactaaacctgctgctaaggccaggcataaagcgtcatcgccgaaggatgaggctccaatttataagaaaaaacctggtgtcaataccacaagcggaaagtatcctgtcgtggtaccgaaaagggagccaatcaagaaactatcgtttgatgaattaatgaagcgagcagagcagaagtctagggaaggaccaaaggaagacaagaagccgctcccgaagaaactcggatttgataaagccgctaaaccaaaggcggcaacgaaagatgctaaacctgtaaaagaaccgaagtcgaaagtgatggtaaagtctttcaaccgttttgcacaaccaaacgaaaagcttgcgaagaagttaaaacttaaagaaaagaaacaaattatggcaagacacggagatcaacattatgacagtgagaatgacgaagatctctcagactttattgaagatgatgatttagacgagtgtgaacaaggctccaaatcacaaccgtacgatagagatgaaatttggtctatcttcaacaaaggtagtaaaaggaaatactttgattcagatgatgacgacgatatggaagctaacgaaatggagatctttgaagaagaggaaagagctacaaaaatggcgaagcttgaagataagagggagcaagcttggttaaaggaacacgaaaaaaggaaaaagaaactgaagaaaagccattcataaacatgtcaatgtacgaattgaatatatcatttattcatctaatatacaattaattaatgcattagttgaaatcatagatccaaatgaaatcaacattttgaagtttgtgtactattataaaattgctttacaatatcaactctataaatccataacatactgcaaagattatgataatgaagatcacaacaccagtaatataatgccaagtaggtgcaaacgtgaatcttgaaaacattaataacaaagaccatgcaccgagaattaaggatatggataatgatatgaatatcatcgtcaaaatagaagtttcgttttctagttgtgtatcatcgttgagtgatttgaacaaagatgtcatgataccaatggttacgcctgtagtcaaacaggatattagcaatgaagaaacatagaagaaagatatcacctggtcatgctcgaactcatatattgattctgaattttgttcttcgagttcccaaaacttattcacgtcgtttctttccgaagaagaagaagtaagtatggaagtgtcagtgtctattgagttgtaggacttacctgcatctcttaataaagatttcctagcttggacgtcgtcaattataccgaatgcaatttggaacttcgataagagatgatagatggcaattatgaatgatgggttaaatctgatgagaccagtatcgtgtgtgtattcgtcatcgtcttcgtcaagacaggaataaaagtcctgatccattgcctcttctccgtcatcaaattcattccagtaacgaattctaggcttttcacgttctgttacagtaggtgagatattcacggctgtgttttgggatgatgactgggaaaattctattgtaggtgggtttagcagtgattgatacctgtcgtgagtcttcttcaaaagagcgttaccagctccgaacatctcttctacggactcaaaattgaggttcccatcgagacatgcaagtggattgctacctcctgctatttttccagccatttcccaaagagtaaaattcctacctgtagggtaaacggaaaggttatccgttactagtttctccgtaagatctaccattattggatcaatgtgtttcttggaataggtcttatttggtacagacgacgatgaagttgcttcgagaattttcacttctagtactgcaaatggaagtttgttatcgtttatctcgatattgtcgtcaatgcaaatcagatagtcgttgttagtttcaatcgatgaatgactaataataaatctgcttcttctgcatttgatgacgagatctgtggtcttgaggttatgtgagtaacaccaatcgcgacaaaattcgtctagtctgttagatactggcatcaacgatggttcgcatccgtttaatacagctttaatatcagtatattcgatggtgtcagtagatatatgattacgaaggccaccgacatggcaaagcaggatggaatcgttggagctcggataagatactaacaaattcgggaaaagattttcctcggtggaattgtaaaggttggtgacatcagcgccaggctttgccaacggttcgaaaagaatattatgagcagatgaggaagaattcgataattgttgtgacctattagaaccggggtcagattccggtgaccctactggagggcttgattctgtgtcacgtcgttgggaactagacgcagcttcttccctttgagcgtctctgaacatacgtaacgatttaatggatccctttctcttagacaagagagcatccccgcttaagatttttttagaagtagctatcacggagtcatcaaacaaacagaaaccaaggttaatcaacaggaacttaatttcatcctcactttcctttgatattaaaaatgaccctaaggggttgaacttcgataagaaataatggtcgaatttcaaagtactgtctataacatgcgatgaagagaccacggaacttttcctcgaagacggagcagtgcctgaagtgatcccaacgttagaattggcccgagaattcgatgtgttgccagttttggtattaccagaatcaacaggttgctggtcagcatcctgttccatttcatgcaaaagatcaacgatcaacgaaatctcaagcaagtatggatccaaatccacagtcaacatagatacaccttcatggccctccttaaattctggacaattcttcaacgagttgataaactcctgtgccaactgcgtaccgtacgggtagtgtttcaagaacttcttaaacaatttcctcactgcaatcttttgcaaaatcaaatacctggacaatttctgcaattctaaattacacctatccaaatgctggttgattaacttgatcctacgtaactttttgttctcatccttaatcaaatgcaactgagtcaaataattctctatcgaaacgatccgtgtactgcactctttcaacttcatcgagatgaaaacattaatcatctcgaattgcgaccgaaacagcttcttcaaagatcgtagttcaggatcatcttcgatactattaggtctaaattctgggtcctggccctctcgtaccgtagtacatcgtctgataccaactttcaactgctgataatcgatattgtgaagtttccattcaggaacagacttatccaatatctgagtcccaaacttcatatctgggcccttatatctctagtttctaggttgcaagatgcgataggggaatgaacagggatacgattcttaccaaaacaaaaaaaacctactgcctcgaagtatcccgtcttataaattgaaaccttgtccttctcaagggtgtttctaacagcttataaagaagagaaagtcttatctcgagagaagagtggaatggtacgaaatgataaggctgggatttactatgtgggccctttataaaaggcaagttaagtggaaaatggaagaagggaaaaaaaaagcgtgtcacgtgcttggattggaaacgttccaacgtggggtcccgtgcaacatatcaaagtacttatctcactcgcttatatatataaatatatatatatatatatattcacatatacatgtttacatacacacatatgcacatccgttttacgagggcatgtgcaaggtgggtgaggaccaatggtgtagaactaggtgatcattttgcacatcaatatatcaccgcgaattcacttttcacaagactagcccaagacttgccctgaatgctgaaaactgctggaagagtaatcgaaaatagactacccacatctccattgggaagagaaagtactggagttgctactcccattattattgtacgcgcattctgtggaagagccacagacgaaagtgtgtattgagatatgattcataactgtctctgttcttaagttacttcggacgatactgccttttgtatgcgtgcgtttcgtccacgtgttaccacgtgcctaccattctgttctgtgccaagtcaaatagttctctcgagcgcccgagaaacgggcggaaaataccgacaaaaggtatatcgcactgcgaaaaatgtacatctttacggtccgaagcaggaacagggcaaccagatagcctagaactcaggttcaacgttgaaatgtcacgatgtgaaacatcgtgagcctatagtcaggccctattttcctttagtttcccttcggttcgctgtttctctctcgagaactcgttttcttgtcaatatgcgtatatattgcacattgtgtatgcttgttgttccttctgtagtttctgtacgaaaaatgtgaaaaagaaataatatttcaagttgctgccaaagtgagaaatagcatttcgcattatctgacctctctctctctcgctgatgttaccagataaaggtttggggggcactgaggtttgatgaacctaagagaccaagttaagtacggagtttcgtgatgcgtaggggtaattctggagcgcgtggtaaccgtggtggttcgcgtgggaaaccgggccagaacgaacatataccgaattttatcaagaacaagccatggtatttggcagaagaaagtgaagtaagtgccagtaccagtgccattaacagtaacagtaccatttctggtaccggtactggtaccggcactgaattagaagaaaaagattacttatcccaccataggctaaagaaaagttcagtccccgattcagggacggcagaaatcgatgatgcattcacttatgtaaggcctagtggaaggaaccgtaagaagaaggattcatatgacctagatttggacgccccagtacgaagacgtgacgagaaagttattgagtcgaattatgatgcgaaaagagatcggtggtatgggtacacgcctgatataaaggagattgaaaggaatcataaggggcccgatacaagtcatagggaaatggacgaggttcagatccaagagatggaaagattgggtttgaaaccggaagatgtcgggttcgatgctactcaaccgctgtcaggcccaaaggagaaatataatccggtcagactaagggaggataaagctgcttatttgcaggatatgtcctctgaggagatgttgtacgatccaaaatcaagaatttataaatcaaaggaagagggtacaatagatcccaaatccaagatgttccatcgccatttgactggggatgccttgcaagtgggtgtaatcaatgaaagggtgcgacaagaggctgttcgctcggggattaaagatttcgaagtcaataaagagaagttgaaccatgttttcgcggcaaacccgaccaaatatgaacttatgatgcgtacagaacctgaacggaaacaggaaacttctgtagaacaggatgcagcaccaaagcgaagaaaattcgacaagaacagtttcaaagagtcttcttcttcttcaaatccgggttcttctacgatgaaggatttgtacgataaatatatgtaatgaattgtttatgcattttgaacatagcatgggaaccaacagaaatttgtcagtcatggaacttggattccatctgaccacaaacgcgttggcccagatttgaactccgttgtctattccttgctctacctcatcatttgtacggatatcatcaactgaaaagaaacgtttgaccaatttttcaaataaaatacaagcgatgagatgagatgagatgaagtgcaacataggaatacggcaaggtcagctcttgccccacctgtagcatcgctcttttgtgtggcgtttgacattatctctgttaacaatcgcttgccttaattatggtagtgttggaagaagagatgtcgatatactttcaaaatgggttaaggaaaatcgcaccatattataatgcaagatcatcgtttgtgaaaggcagatggttcggcaagtctttgacccagatattcattgacgagtttgcacatacccatgaagaagcacaactgaaaataacggaaggttttatcaagctgttgagggaaggtaagcagctggaaggagatcccattattaagaataaagatattctactcacctaccaacacaaccatgaacctccagtcaaaaactggggggaaccaatttgtgacgagaagcacattatgggaattccaattgtgcatcaagatgaacaattactagtcattaataaacccaatggtattccggtacacccaacggcctatttttataagaatactttaaccgagctgttgaaagattctttgggatatccagtacacccatgttatcgtttggataagatcacttctggtttacttattctggccaaaaatcccatcgatgctaacagagttcaatctaagataagagatcgtgatatgaagaaatattatctagctagagtaaaaggaaaatttcctgaaactgcagttgataaatccccaatctatacctgtgacttgaaaattaaatcagagccattatcccctttgaaagacgcacatactgagtttgaattaatggaatacgatgccgtaactgatcaatcaattgtattatgcaaacctttcacgggaagaacacatcaaattcgtatccatttggcaagacagggacaccccattacaaacgatccgttttataaccttgataactcaacgtacccattacggtcaaggtttattattgagaccccagattggactcaactaacaaacgaaagaatcgaaaagctacggaagcggttcgaggttgaactggatgatgtctgggatcaattgaatgaaaatcaagaacgatgtcctgaatgcgacgaagaaatgccaaaagatccaactccagaatcgttagagctatatctacatgcttggagatacaaaggtttggatttggagtttgaaacagattatccctactgggcgaagttcgaaaatgagaaacaagcttaacatcaagttttgagttgtttctttattcatgtatttaacttttttagtatccttctcaatcaatattgtatatactatatatttattcaaatagcagcatatgtgttcttgcatttgttcttcaagaggtcaatttgttttacttccttgtatcattcttaccaaccaatgtccttgcgatgtactggcttggccacctttaactttcctttagtcaagttttcaagtggatacatagatactttgcactcaccaccaagctcttcaatcactgataaagattgagtttcaagatccacagattttagaatggccacaaacggcgtttctattcccaagctgtacgttaaaccatcgtcaaaggtaaattcagcgtttcttgcaacaagtatcaaacctggtaccaattttcctagcgcagcttcatctattgcggtgttataagcatgttcaaaaacggtgataccgtaagttctttgagcaattggtgggactagattatctattggacccaatatttgaggaataaatgaatgacaagctttaccaacacatttgttactgttttcgtaaattgttttgattaacagatcactaccagtactttgtgatgaggagggaatatagtcctgatgggaaattgctgtctcaattggattctttggatcatatacaacatatgcttgaatttgagagtaatcttcgaacaagaactggaaatctctgacaaccaacttatttgtattccttctttcaactatgtgatcctgagattcccagatgtattttactttgcttggtttaacagtatcagcctgaactgtcttagttaaccaccaagtactttgctttgagaactctaattctggaatagtacctggttcaaatttcgccgtagttgtccgtcttaatggctggaaactggccggaatttgtggagcagcagatgaaggagtggctggtgatgagtttgctgcacctggaatagtctgaattgaaggtcttcgttgcggtgcattagaaggaggcaatggtggagggccgccactgcttggtactggaggagcaggggcagcagcgggctgttttgttggcagtttctgctcagtgttttcggttttaacgcttaaaactggtgctggagcctttgttggtaatggtggtacaggtacgcttgaaggaacaggaggaattggtgcacctgttggaattggcgggacggaaggagcagatggaattggaggggctgcgggcaatttttgtggggcgttagtagcttgtggagtttgtggagtttgtggggatcccggagaagtatcaattgtataaacatgagtgggcctaattctttgaggaacagttggcgacggagcctcctcttcttcatcttccactttcttagtagtttcatcttcggattcatatccagaaaggccttgacttccctcgggtacttcatctttatgttggaagtctgggtctttgtcgtaattcaccgaacctgtaatagcaggttgagcatcatcgactccatctacaaagctagattcgctttcttcgtcagcttgattttctggggtttcggcatgaccagaagtttccacagcaatttcttcagtcttcttcctaaacattggcagcatcgatgggtcggcaaatggcatgacaggaaccgctgttggaagagatgacgtttcagttggactttcagattcttcctttggtttcttgcttttggttggggtcttcgaagagtcagcagaaggcattggcattccaaatgggttgaagtacgcattaggcataccgtatctacttgcatttgctagtcttgccatcttttctcttaaagcagcacgtctttgttcctcttcattttcgtcttcagaagattcattttcatcattatcatcacgatcgtcattctcgttaactgactcctcaggaatagagtaggtacgctgagggtgagagccaattgaagcagtatcattaggaattggtggagctgtgtgaatgctagaagtactgacatcaacttctggattttcagcatcggaatcttcaataacagaggcatcataactttcccttttttcaatattaactggagaagttgcactagcagtagcaacgctgccggttggggacgacacactagaaatactttttttccgcttatgcaaagtttccgcctgttcctgttgttgtttctgcatatgctgtaacatggatatcctttgctgcaaggacattttagattccgacttagcctcctttaccaaatcatcgctattaacaaaaccactcctctcagtatcaccagaaccttcttgaaacgacagactatttctcaactgtctgacattatcctgagaaacctttcccttctggactggtgcagttgcagctgcagcatttggattgacagtctgtgtttccggaatcttgaccggagtttccacatttggtttctcctctggctgcttctcttgagcaggctcactagcagtttccttcaaaggttcactaacaaaacctttggggaaaataccttgctttgttttaccatcagcatccttaaactcaccaaagaaccactcatcgtcttctatttcaagcaccgtaatgatctgacctttggaaaatggtaaatcatcctcaaaatctgaggtgtatggaaacaatgcctcgaccttaaatggcacagacatctttaacacgtaatctagtttcgagaactgttcttctagtaagctggtccttttatttcactcgccgagtgttctttgttaaaggggtggtgaaaagttcgcgatataaggaatcgttttaatttcaaaggctttagtaacatttttccaaacaattttaaaggattagatttcaccgaaaggtagataacgaacgaatgatagacttcacgtcaattgaaaggcatatatgaacgttcaatcagcaggtgagggttgcagaacttatgactgattggataaggcatgacattgaattcgaatactcgtttggcgagattcattcgatttttagcgtacgactatgattcggaaattgatagaaacgctttgtatcgtcgcatcgttggagttattggtgttaatgggtttatagcattgttaaaaaagcaccggaagttaacggccagttcattattcgatggtttgcctatcgttgttgctataccgttactgagaaggataattcgtcaaagacatgccagctggttcctgggtttaacgattggtctctcgcagctcaaggctaagctaccgcattggattgtttcatactgggctgtagaatctgttgtagatcaaatcaagctctgggttgattattccagtataagcgaacgccgttggattcttctcaggcaattggcagctagtctcttgataccaatcctataccacagaaatcaatcgaaggggagattatacaggatattattcgagactagaaaaccttggaaggacttccttttgttatttgtcgcatggaatgtcgtcaagacttataagaatgtgaaatccatccttttgaaagagaagcttaagaagaataaagtgaatacttcctcaatgacgttcgattcagaggcaaaggaatctcagacacaacatggttcaatgacaaggatactcatgcaaaggttagaagagttaaatgagttatccgataagaaatcaagcgggtcggtcaaagaacgagtgtatggttatttcttcagtgacaattttatcaaatgtgtaaaatggacgctctggagacaggtggtgatgttaatcttcaacggtcaacattccaaatgtctaaagccattacataaatcgatcatcatcatgttgtcattcactttgctgagcgacccacaacatttagatattaactgggagctactcaaatacttggggagatcaacgttatctcaagaacttggtaggataccacattatcaaaaaccaatcattttcgctgcccttagtctctcatatctaaccaggaacccaattgcctaataaacagactgatttgttcctagtttgatttgtatcaatatgcgtgtgttccttttctaattagagtcttttcgtgtcggtgtgtatataaatgttacgcatatgttgatctatacacagatcccgtatacatacgtatatatatatatatcacgattcgtacgtttctaacgttaagagcacttatttttgaccagtggcgcctggagcggatccatttcccttcaacctttgtaggatttccttgaatttggatctatctctgccatctacaatgtcagcatcctccaagttgatcaactgaagagctttgtcccaaacagtcaaatcttgagaggcaaaagcatgagtcttagcaaggaattcttcagcttctttttgagtttgatcaattccctgttgcttcttaatgttatagttttcatagaaatcatcaatatgttttgcagcttcctcttgtaagtctgccttggccttatcttcagcttgatctctttcagaaatttcaagctcacgtctagctttccagttttccaaagcctcggacttccctcttacaacaggctcagcagaactactctgtggttctccgaattcgtcgtcgtcttcttcttcttctaccgggttcgatacaccttcgacgtcttgtggttgatatgatgctgctgcaatggcatctgcttcattgacagatgttccaagagtttttgaatcagagtcgtccttacttagaagctcggagtcttgctctgtcttgaattcatcacctaagatctcggcttctcttcttagaaactctgtttcgtcaccatctccagtaacaaatccatcttgcactagatcgtcttctaactcaggaaacttatcagccatcttgttcaattgtatctatatacaccactcgtgtccttaataaatctaacttacacgctagagagctgtcttcaccttcaccttgctgtgcttgattccctcttgtagacgtttatttcaacttcaattgaatctttcaagtcgtcaataggggaaagcctggtatttttgtatcacgtgatatcgttgtctacaaagaaagctcatcctatatatagtacttactgctgtattacagaatcattccactagtatggataacgatgagcctaggtctactacatctaatgcttccagatctactattttgattcctttcgtattgtgatgataaccttttgcgatagcgatgatttcaagatcacattggaaggttgttcctggtgataacagcggtagttttagatcatttgtgataagaatcaaggtctgtgctaatggactctttggtctatgatacactacgagatttaacactctaggagtagtgttttccacttgtaaagtgactttgaagggctctcccttcttaacggttatcttggattgaaggaaattgaaatgcgcctgcgccaggacacgcggtagttggacacttggaggctggataaaggtaggcgtgctggtatttgaacttactatggacttagagggagttggcttccctagacacacttctgtctcccagctcgtacgaattttataagaggatccgatcttataaataattgtaactttaatcaatctcgtggaatcctgtaactgataatttatagtatatgcatcatgacgtttcatattaagcggaaattctatcatttcctccataggttgtaggggtaatttaaaattcccatcgcagagttcgtaacatagggagtcaacagtaagatatggttcttctggaaataactcctcaaacttgcgtgctagttgaatatcaagagaagatattacttgagaagttgttgaattcctttctggtcttattgcaatgtttctgagtctcatattcatcaaagagtatattggtaactccactgtttttgatttcaattcgcgatgaaccgaatccgtactttcggctgatcctggtggagatgcagttagtggttgaaaagaggggagtatatccgattcattaccattggatcctaatgcttgttcattggttttcaatggtggctccaagtaaaagaattggaagctgattcgaccttgttggcctacattgttcactagataatcggaattgaaaacggtttttctgataaacgttggatctaattgccatacatggtcattatgtttgataagtgagtctgcatttttatcaattcgtactaggctatccttcaaattaatagctaaagagtgaaacaggtgttttaacgggtcgacggatgtgatgaataatggtaactcttccccaaaaataataaaagaacggctgattgtatccgagacatgaacaccagtatcatcaatgctgtactcttttagcggaattgtcacgtcaatcatcttggggtctatgatgcactacctagaactcttcccggtatcactattttcttcacatattcaattccgccattgagactgttttctttacatctgcaagattgaaaagatcacttttgagatgtttccttaatatgatgaagatacatgtctgaaagaagagaaggcgcatcagtatcaaaactaactttcaaagagtaacctttgaaatgtttatttgtatataatggagcatgtcaagctttgctgagatgtatttatcttctttatggagaacttaccgtttcaattcgaaagagagatagatttcgatgataacataaacagatcagatcataagtgattcaaagcaacaagatttattcaattatgtactagtttgattatttgcaatatcggtttgtgttggaggttgtggagatgatgaagatgatctgccaggggaatctgcagatagtgacacaggaggagttaatgcagcagtcgattgctgtaagggtaaatgcttctcctcttctgcttctagttctgcaggagattcattcaacgggtggaccttataaacacccctttccacctcttcggagtcaaataccttatttttcagtttgttccaattatcatgtggtatatcccaaccacatttttgagccactaacgctgcgacatcatcacataaaccaagaagggataggtcgaattcggcatgctttactgggtctttgttgattagaacttgtggtacatgggcaggaatcatgttaacaatttctgataccggtgcgactttcaaagatgtaccaatgcagatgagtaaatcacattgtaaaacgtcttctctaattagtctatggaatttcgacggaagggcttcaccgaaaaatgtgatatcaggttttaacacaccaaaagatttgggtactgaccgtccatgatggtcatccatatcatcatcctcgccatctgcaagctcttcatcagtcttggtcttgaaaaactctagtcttttgctatagcagtaagggcaaataggaagttgtaggtttctgatatttgggaagattctttcaccttgaatcttccaatggcatgtgacacaggatgcagttgcaaatgaaccatggcattgaaccatcttttcaggttctacaccggcgtaagactccaaattatcaatattctgcgtataattccgcaaaagtttatctttatcctggatcatcttgatgaaactgtgtaaaggtgaatacatgttctctgggggtagcaccatatgagcaatattataaaagacagatggatcctccgtgaaaacttccaaactgaaaacatcttgtggatcatttaatccaagatctcccaacttagagtagaaaccttcagatgatctgaaatcagggatacccaaagaagttgagatacctgcgcccgttagtacaataatttttttagcagttttcaactttgccacgaaatcatcgatggtatggaagttggttagtctaattctagtcgataacactttgttcattgctttttgcaagtctttgatcaatctaacagcatgcttcttttctaaaggatcttcgaaacttggacttggataagtagctgtatatgtatctgatacatttttagtttcagagctgttcttctgaggtaaactatcatcgttgtcagcgttatggaccacttcctgtatggcaagcatcaattctttatctttgatctgaaatcccaataacttgatcatatgatacacgtataaagagttcaagtcctctggtaggtaatcgtccaagaacctagcggaaccaaactgtttcaagtaagaacgggcattaagagaatcctcttttgaaatgacagggaaaacatacttcctagaaaccgaacgtctttccaactttatcggatgttccggtttctggggggcatactgtctatcgctcaaagtaccattagtggccatggtaccagtaccattaccactaccgctattagtatcagccgaagaagcagctagtgctgtagaacctgtgttagaagatgttataccaacatggtcagatgccgtaccgttgaaattagaagagacttctttctcttcgtattcatcaaccacttcgtccaattcgtcggccttagtttcttccagtatatccttctgagcatcttcctctgcatctgcatcagcatccgcatccgcatccacatccgcatccgcatccacatctacgtcctcattctccggactcctcgcggcaaacacgtcagaatctcccctcgctttcttcccagactccaagccaccatttccctctgccacagactcttgttccaacggtctcttctgaagagttccgtaatattcagtcattaaactaaaaaaatcgtctcgtacccctaaatcaaagtaaaaaagttgatttgaactccagataatgaatattccgcgctccagttccagctagtaacaatgagcaattaaatcggataccccaatcgtactctcttaacaacagaaacagaaaactggcactgactctacccagaacaattcgcttaaactttacgatattaaagttaaaaagaaaagaattattggctttagtcttcaaaggagaaggaaaaaagatagacggcgaaagtgcacttcagagagaaacaacgcctcttctaccacctcttgtacctagaattcaacaatcaaggatgcgcacggatccaaatgtctgaaactgtcgccggataagtctgctggtcgtcactacccggtataattaggtggttgccatgttcttttcaaatatgtcttcggggttttagtttgtttcgtgttttcgctttagaaaaaattcgaagctggaccatgttttcttcgtcagttgtgatagtatcacgtgacttaatcatgacacgtgacttggttctttattgtatttcagggttcattgttgtattcactataaccaccgtattcgaatctatacttgggtccttcttttggcgctgctgctgctatacctgctggaccaaccgaacctgttggcggcacaggtgacatggcagcggtgccaggggttttactagtggtatttcctgcggcagcatcaatgctggctccggcactggtaccggcaaattggtttttagatcctttgttgttcggttgctccctcatgccagctaacggaccaacgccgattctggacaacgctaactccgcgcttgtgttatcaaggttcaaatcgttgacaatgtaccctgtttccttgcacaattctttaactcttagtatcagctcgacttcttctctgttcttgagatcgacttgttcctgtaacgaattcacgtattctaccgcctgcgttagaatttgtccctttgtgggcttgttagcatttgcactggtccccttggatttagaaaccggttcgtctttgatcttaggatcgctgttctttctataatactcttcgaaaaattcttcaggaataatactcaaaaattgttggattagttcattgatattaccacgcttggcaccatcgtcatcattcatggttaaaattagtaagatagagacttataccgatggtaagatgcagtattgatgctactttccttcacctttttcttgccaactcacagcattcaaactgttttcatctgttattatttcattttatatcaaaagtcaggatttggaataactaaatattagaaaagccagtggcgaaattaaagatcaacctttacaagatacacgcctaacagcacaacattaggtatatcagcttgttaccgtccaattatcgagttgcattgaggcacgaactattagctggcagtaaggcatcaaggtataagttaagttacagcacgaacaatgggtcaaggagcttcttctcatgggcagaagaaaaaggataagaaacaaaagccaaaatatgagccaccagtagaatcaaaattcggtagaaagaagagaaaggggccctctacggtggagaaacttcctagcgtttatccaagcacaagatgtaagttaaaacttttgagaatggaacgtataaaagatcatttgctattggaagaagagtatgtgacaaactctgagatcttgaaaccatttgagaagaaacaagaggaagaaaagaagcagctagacgatatcagaggtactccgttatctattggtactttagaagaaattgtggacgatgaccatgctatagtgacaagccctacgacaccagactactacgtttccattttgtcctttgttgacaaagagctattagaacccggctgttctgtgttattacaccataagaccatgtcagttgttggtgtcttgcaagacgatgccgatccaatggtttctgtgatgaagatggataaatcaccaacagaaaactacagtgatatcggtggattagaggcacaaattcaagagattaaagaagcagtcgagttgccactaacgcatcctgaactatacgaagaaatgggtatcaaaccaccaaagggtgtcatattgtatggtgctccaggtacaggtaagacgttattggcaaaggctgtggcgaaccagacttctgctacatttttaagaattgtgggatccgaattgattcagaaatatctaggtgacggtccaagactctgtagacaaattttcaaagtcgctgcagagaatgcgccaagtatagtctttatcgatgaaatcgatgctattggtaccaagagatatgaatcaaacagtggcggtgagaaagagattcaaagaactatgttggaacttttaaaccaattggacgggtttgatgatagaggtgatgtgaaagtcatcatggctacaaacaaaatcgaaagtttagatccagctttgatcagacccggaagaatcgaccgtaagattttgttcgaaaaccccgatataacaacaaagagaaaaatcgtcggtattcatacatctaagatgaacttagcagaggacgtagacctagataatttggtcacttcaaaagatgacctatcaggtgcagacatcaaagcaatgtgtacagaagcggggcttttggctctaagagaaagaagaatgcaagtcacagcacaagatttcaaggaagcaaaagaacgtgtactcaaaaataaggttgaagaaaacttggaaggtttgtacttataagtagggattaatcttcatatatatatatatatatatatatatatatactacagtttaatatctttaatatcttcacatatccaaattcaatctccctgccgccaacatttatgcaatgatttatcaatctaagtttgtatttttaaccttttacactttcacaacttttcgggcagatagagggaaacgataaatatagaaattacgaaaagttgaactttaaatgttttaaagattgaaaggacaacagtataatgagatgagtagaaataaactgcaaactaacaagagccttgcagtatatacgaggtgaagaaacctgtgacttgtgattgcgagagaaagcacaattagttattgtcaatttttttccttatctcgtttctaacaactgcattattgattggaatttttttgataaaagttcaattagttcatatttaaggactgacaaaactttgtggtcttttcaaggagctatataactggataagttccattattggtatttgtgagggttcaaggcgtgtcaatttttttctgaggtcactggacgttagttttattcattgaagtcatttaaagaacccttggatatatcgagttgcttttagaagtcatgtcagactctccggaatacgaattgacgtataaggttggggtggccgaaaataacaactccaagtttcggaaaacgatggaagatgttcatacatacgttgagaattttgcatcaaggctagattggggttattttgctatctttgatggacatgtaggaagtgaggcttctaaatggtgtggagcgaacttacacagatacttggaacagaaaatattagaggatgaggcccgtgatctgagggatgttttgaatgactcgtttgtgcatgcagataatgagattaacaatgcattgaaggggaatagcggttgcactgcagccgtctgcgtgttgagatgggaaatacctgataccacagtgcccagtgaggacgaaacgataaatttacaacaacataagaggatgttatatacagcgaacgttggagatacaagagtggtacttttcaggaatggcaacagtatacgattgacatatgatcacaaggcttcggatattctggagctgcagcgtgttgaaaatgcgggtggtttaataatgaagagcagagtcaatgggatgctggctgttaccagatcacttggtgataagttttttgattcattggtagtggcaaatccatttacgacaagtgttgagattacaacgagtgatcagttcttaattattgcatgcgatgggttgtgggatgtgatagaggaccatgaggcgtgtgagatgataaaagacataaataatcccaatgaagcagcaagagtattagtaagatatgctcttgagaatggaaccacagataatgtgaccgtaatggtaatatttttggatacttcgcaggagaactgaagtcagttttcgatgttaatgcagttgtataaaattatagatatatatatatatatatatatatatatatataagcatatacatatcttcctagataatacgttcttctttgaagcagagctcttttttagaaatcaattgaaaggagttgcgtagttcattgaccaattactccatgcagaatagagcattagaaagcaataacggtattatattagacctacggttaattcatgtcataccgaggtatgacaaacatcatatgttaaaatcttccaaattcaattcattattgtcgttagccgcattccaatcaatgccgaggtcgttgaaatcgttcaacgttagataactacttggattgccattttcaggaacgtttactgcagaaggtggtgcatttgtatcattgaaatttatttgaggatcattctttttctcgtttccaccagatgtgttttgtaacccgccaaaacctacctggttatccattgagtcaaacatagaaagatccatgccgtttaaatcaccaaactcggagttgaaagactgggcttgagtaattccagcagacggtagatcagtatcaaagtttgttagcatgtctattggggtgttcttagcggagtatctctgctgctgttcatgttgttgttcctgtggctgttgctgttgctgttgctgttgttgttgctgctgttgttgctgtttctgtttcaattgtttttgctctaattgctgctgttctaatttctgctgttccaataactgtctctctaacttttcttgttcttgtttcttgatctgttcttcctctctctgtttcttcaactgcaatgcgctatctttcactgccccaacgtaatccgccgttgtttgtaatgaaacgtctaaagtatcaagaagcgagtaaaactgcgttattctatcacctagtcctttctgctgagcctttgaaaaccctgtcgtcaccttgggatctagtttaatagttttcaattgctgttgagttaacaaatcagctgaaagtcgaagtatatcatcgaaatattgcgtcaacttgttctcctgtctgtcagaaacaccagtcttaggtaccattatgaaactgacgtgtttaggaccgtaagacgtctgaccatccagggttctgggagcagtcctgtatcatgtacgatgcggataagtgattatgatgaatcgttcattatacatttcattgaatagtggtttaaagaaaatcatgagccaatcaaaacgatggaaatggccatattcgacagggtaacaacatacattttatcaatcagggacccctagcttcatacatcatatctactacgtgctacaaaaagtactgcaaacaggtgtcacgtatatacactcatttcacgactacactagagctaggtgtccctcaacggtcttttcagcaaagccattgacgtttcacaggcttgaaaacacctcttctcgagtgcatcaactttttcagttttcagttttccaaggcctcaattaggatttttgaaaatgaaaagaatgggattttagttttaattacagctttacgatatttgtgaataaggttttactagaactgttcttgttggactactgttgttccttcttagacttttgtattttgatctttgtttagtgttattagattttgtttcaattgaattcattacagtctgttttaattgcttcttgtccagaatcgaaatcataagaacacattaccagaaaataatcacctataatgttccgtttatctgctgctagaactttggccaaatctgtcaacaccgttgttgctaagcgtacttatgctgaagctgccgatggtgctttgaagttgcaatttgctttgccacatcaaaccttgttttctggtactccagttacccaagtcaacttgccagctaagtctggtcaaatcggtatcttggctaaccacgttccaactgttgaacaattggttccaggtgttgttgaagtcttggaaggttcttcttctaagaagttctttgtttccggtggtttcgctactgtccaaccagactctaccttggctatcacttccgttgaagcattcccattagagtctttctctccagaaaacgttagatctctgttggctgaagctcaaaagaacgtctcctctgctgacgaagttgctgctgccgaagctgctatccaacttgaagttttggaagctttgcaagccgctttgaaataattgagatgaacgaagaattacaattggaccaaggtataatacacttgatacggatactctacttggaagcaattgttttcccggttgattgtaaacctgtctcggcgtttgtattatccttcgtctgcttttttttcattattctaattcctattattccattgcacaagcttacacaacacaacgacgaatacatttcatgatttagcctaaagacccttttttgttgctccggtcattgtcctttctttccatacaatactgtagtgtgaacgtacgaataagactgggaactattgagaattaacctaaaacgactattactaaaatatacaacgaattaaaacccagcgaattaaaagaaatcagaagaaataaatacgataaaacctaaaaattctaaatgatatggaggttgatacaagtgatgtctcgattccgtttcaaaagggggttctagtctttgttttaatgaccaacaaacataaatctttcttcaatatactattccttcctttctaacaatatcaaagaaaacactggatcgattataatttgtctatccccgttaaaaatattatcaattaagaaccgaattgaaagacttagattttatattttttagcagaaacgatttgtgtgtaactgatgtctagttttaagattcatattcatatataccgattaaactgactgcgcatactgagagagatgatctggttttggcatcaacaagagttagaaaggcagggtaataaatgggtataaggtcctcacttgttacccggattttataccacgaaatcgaaatttttccggcgggaaatcttttgaggtcccagaaaaagacattgttttcccccaaaaatattttcgcgatttttctccataacgcgtttccgtgatgagatctataaccagcaatcctttaacaaatatcattgataaacactggatgagaagtatgtctattccatcatattgattgcacctttaccaataattttatcaaatatatatattacctatggaattttaatgtcgtgacctctgaaaaaagacacagtgctattttatttcatttttattttgctaaccattccttataagatcaagttctaatctcgatcttaagtttatatccatttgctataccatttgcaacaggaaccacgagccttatatcacctaatccaaaaataaacaacgtatatgccaccaaatagcaattcacatactcaggtgagattaaatacaagcaatgggccgttggctcagatctggctggcttccaatttgagtagcatcaatcggaacattgcaaagactaatatcgtggaatctgttgaagagattgccaaagctgcaggtgttaatctagatgatgaatctgtggaacctatcacattacgtgcttccggtgagttactacatggtgttgtaaaagtttattctcaaaaagcatcctatctgcttactgatatcacagacttactgagtaaagtgaaatctatcttcaagggatcgctgaacaagagcgtcacaattcagctagatacagtggcaaagttagatcagcttttattgcaagatgcggttacagaacttgacgtcttggagatgcccagtttggatttcttgaaagatatccaagtgccagaaggttttttgatcgctgaacgatcaatggaaagacaagtgcaaggagcagcacctgtaacatccgccattgcagcacaacaacaagcatgggatatgtccttagaagttggaaggcgattcctggcagatgaagatgatgacttgaatgctattgaacatcacgattcatctcatttgaaattagattttgaccttggtgattctaatcaaagcaataacactaaatcatggggtgaagggactcgtgttactgctagtgaagtaaacgcggatgatggagaaaatgaaggtgatttgactattagaaatgacaatgacgatgatgatgaattgctaccacttaacgatgattgggatttgggattaaacgatgatgatcagaatatttctggtaatcagtctagccatggtagcgacatgtctgtagagatcgggagaagggctgatattactcactcattgcatgatgatacactcttagactttgatctagggctgccaaaggacacagaaccagagcatcaagagcaagcagaggcatacataccacctagagcagtaaagaagagggcaccaaggaataaagcctttatcaatgttaagaaggttctcatagatgctgatgccgaattaaacgattctgaagtgaaaggaggaccatcggactcaattcttatcgtttctgatgagacttcgtccgctatatcaaagaaaaaaagagccatcgatgaattatactctgacctggacttccttcctcaaaagattatatctaatttcttcaaccataaagcttcaaagaagcctagagctctgtcacaatccagccaatctgatgggtccgatgttgatatagatatctctttgggtatcgatggaagtttggtacacaattctgatccattcgatcaccaacaaatgggctttgatgcagaatcagaaggaccagtgtttgctgatgatgaacctccagttcttgcagctgatacatccatggaagaaaatgattaccaagccattcaatcagacgaatttgcctctcgtgggtcaattgaaaaggaaaaaagtcaaaaagtagagcttgctaccggtgaaatcgtgtctaaatctacagtggaaatggcaactctactgagagatgaaatgagctccggtgaagctacttttgataaaatccttacttcgaagtaccaggataacgcggtaataacaaaaagaatggccagtaaagcattctttgagttactttctcttgccaccgcagactgtatatcattgaaacagaaggaaacatttggacaaatcacaattttaggaaaatcaaacttatatgagacgtttgttaccgcatagacttttaatttggatacttttataacggacattatgtataaataattaataatatctgtttttttaagttggtttaaatatacatgacggcagatcagttcaagttgttgtgctattcgatttcttcatttggttgttgctgttgttgctgctgctccaagtattcttgtattgataactggttaatgtgttgtaaaagctcctcatcagcgaacctgttcatttgggatatttctagatgtttactatcaattagtccttcgattgtttctactacatactcactttctctatcatgtggttgtggtggtagtacatcgaattcaaacacagaatgatctgaccaaatttcttcgggaatagcagccataacggatgactcttgagaaagaatagcaaaccttaacaaattaattggaatgttattgatgaagaatgatgttggcgccacgtcgtcatcatcatcgccatcatttatatccttcactgcatcagtgtcaaacgaagtggaattaaaaatgcttgctaactcatcaagtaaaaacttcttagcttccgcttccttccaaatggcgcccattctagtagtataagcttttgtctcgatagaagcgctcacagtaggaggttttaatttaattttcaatttggatggatcaccaagtaacacttcttcgtatatcctgtaaagagatgaaggatattgattccaaacacgttttaacaactgcttagcttcttcaatgcaggacaatttccaataagaatatacggcagtcattcccagtcctaaagtaaaccactgtttgtataggttgaataaaggattctttatcatttgaataatgtactgatattcatcattggcagccaaataatgatccatgaaatatcttgctcctaaaggatcttccaaaggtgataaagaaagaagagttttacaccactgagcggctgttgaaacggcacctctttgagatacgatttgaatatatctcatgatagccaaataaaactgtctgttgtaaaaatatatgtagggaagttggaaatccttagcagtgaactcaatcccatttttcaaacaacggtcgaagacaaatagtgcacgttcaaccaaaccattactgttagatttgtcaccttgccttacgcatatcaaggcaacttgtaagagccctggtacatgataagggaattgcgaagatattattgatattagtgcttcatgatcagggtgtaagactgtactcaggtagaattcggttaaagcctttttgctattggtatcgtttaaagcatcgaatttataataagtaaaatgcttagaccatttgcgttcaacatcgtctttgatgacagcatcccaatccaaaggacgctgccatctcgaccattttgttagatcgtcgttagacaactttttcaagatgaattctccacgtactgttggtagccagtcgtctcttatcttggtgaactgtaactttcggacagacccgccgttggggacacttctcttgtccttgccactccagttctttactaatctttttagtctctcaatttgcttcaatacttctggtgatacatgagtggatgtcacagagtcaatatcttgtaaggtctctggtgataaatcatcaaaaagtaatttgaattcgttatcaggaattaactgcttgaaatcgaacttattaaacaatgcattcaaaggtttgaaatgtttaaacttagtaaacccaggatcatctctgagattatattgtttccaagtcgataagttatcctcataaccttggctaacctcttcatcggcagtcataaacccatcatcgtcatcgtactcatcgtattcctcctgagaatccagcgatttgtaagatgttatatttttcttttggaattgagtcaacaaacgagcaaactcttcatcatcttccccatcttcgtcttttaggctaggaccttttttgctttggttcttagtcttcttattcttctttttacttgtcttcttagtattcctcttctgagatttagtctccagcttaattattggagactcctcctctactggtgagacagccgcttcttcctcttcctcttcctcttcctcttcctcatcatcatcatccattaacataaacatatttgagctagttactgttggttgagccagggattcatcttcattttccaaggctggtgacgatgagctagctttcgatgttagcttgagcaaagtcgtctctaaatcatcctttcctaatcttctcaactgtcttgaactcataattcacaatattgctccgtgatacctttgaagctagcagaatatggcttatggtcctgccggtaacgatataatccctttggaaacgccatagtagtgatactgtcttatatatgtataatgatctgaatttatgttcatatcgaaaaccagttcacgtgatctacaaaagaaattttccaatgtcttgaaaaatttggtactagtgatgctcttaccttgatcttagaaatatgaagctcatctcatcgacatggaaagagagtccagtcatgagtagacaaccagtagactaggttgccccaatacaagacaataaaacaagcccccttttgagcaagatggcgaagaaaacagtgagacagcaggactttatgaagcgtaagcttaaggttggaaaaccaaagcagaaaccaagcaatgtgactgatacatctttccagatgaagcgaatctcgctaccatcacagaccaagatcagcagtggttccaacgggaagagcgctggaaatggtacaggcgtattggatttgaaccaagaagtgataaaaagagtcagcttgttgagacatcatagcgatgtcacgaggaaagaaacagtactatatttcgaatctatgatctcgaggatcatccatctaccgagcatgaataatctaatgcaatcatccatcccattgatgtgtgattcatcaaaacaagtgcgcgacgaattggccaacttgcttgataccattgggaagcacgatgccaatgtgttgaaattacagatcagagccatcacattgtatttgaacaacgctatgacccatataatcgctcctatccaaagagactccggtatgttcgtacaagtggtgttaaagtactgtgctgacgagctagtaaggcacgcatggatcaagatgttgaaagggtttttccaggtattgggatggaccatagtcacgcaagggaacaacaaggcaaagggcaagtcgataagtatggggattacaagcagcagtgtattgagtatgaacaagaacaagaagcataagaacgagaacctgaaggcgatgttgcaattcataagagctggagtgctaggagctgctgccattggtcacgaagacagaaaccccgaacagggtaacggtgctaattccgtctccccactattacaacaaagatatgtaccgtacatgataccggagttcccacaaccgtatgcatacttgaaactcttcacgagacaatttgcaaaaggcgaattgaccagtacaggtgctgaaacaagtagcaccgacagtggaaatatgactctcgaggagctagaaacgttatcgtgtgaggatacacacacaagaagaatggtattcaatcaacatttctatccaagcatacaaaggcaactaccggctctcatcaaggacggaggggagtgtggccgtacggcccattccttctccagcactttggaagagattcttcaaatcactgtataataacaccagacgtaaatagattctgaaaaagaaaaatgctactgcaggatttaccgttttcccagtggtgagattctagtttcagacgcaatacgtgataaccttgggttgttccattaatatatagtatactaccataaaattattaagactgggctgcaactactgctgcagccaactctaatcaccgatgatttaaagtgctcggttgctatccagtgtccttgcctttggatattcctcaatagcgtaccaaaggaaaccaaaaaaaataagattgcacaaactcttctcttatcgacctgaagaaggcctaaccgataaacaccccaacctcgaacactgtgcggatactgtgccccaaaaaaaaaaaggctcgtaaagtttcattcaacaaaacatgatgccactccccagtctatgtgacttgtcctgtagacactcacacctctccgtgtgaatatgcacgaaatcggtgtgccttgttctctttggtatcactgcgaaacgaaatttcccacacaccaaaaaagtgtgaaaaaaatttcaacgtttcgaattcccaagatgtttccaacattaatactggactgtaaagtgctgtagagtgctgtgatgctgtattcgtccattattacaagcctagttaccattcttggggattattacttagtaccttgccttggaatatatataggcaaaagtatttatatatagatatagatatagatatagatatagataccgtattcacgttgcctcatttcccaattgatagtagtaggctgggagtatatacaaagtacacttcactatacaagtactatcccatatatcgaagctttcgtcggttgtaaccagaattgattttcctttataacggacgagtcttatagttttcctatttttctttggatcatttactataggagattttgaaaatttagttcggaatcttaagcatcttctaaacacaattcggccaatcccttgaaccgataaaagaagagatataagcctgttcattaaagaaaacagaaccagaggttgtgcgaaacgtatctgttggctagtatagagttgattaccagctttgttctctctctttcattttttcagtcccatttgtttgatcttttagttgcctgttttttttttttacctctttattatcttttccttttaacacatcagcttcatcctttttttgactggttcaaaaaagacatcatacagcagctcatatatttggtaccatcatcatgtcattttccatgtctggacactctcatgtgaattcttacggttcaagtttgaatgccagttctaattcagcttattcaaacgtttcctttagatcaaactccgtcccagattcatcctcatcttccatgtcagtagctggctcaggtcctattcagaattctacacagctttacatgggtgatttgaacccggattggacagagaacgatattaaaagtatatggtcgatgttgggcgagcccaacgtgcaggtcaaattgatcaaatcgtcaaatccaaataaatcacatgctgttaacaattcaggctactgtttcgtggagttcccgaaccaaatggcagctagcaatgcgttgatgaaatcgggacttcgagttcctatggattcgaattatgcgttgaagcttaactgggcttcatttgccactgcgccaggatctgaattcactcttttcgttggtgatttggcacccaacgtcacagaagcgcaattgtttgagttattcatctcacgttactcctccacattgaacgctaagatcgttttcgatcagttcactggtgtgtcaaaggggtatggattcgtcaagtttgtcaatgaaatggaacagcaaagagcgttagtggaaatgcaaggcacgtttttgaacggtagggctatcagagtgggcacaacttctaagaataagcagggccagcaaccacaacagcatcatcatcaacagcaccagcatcagcatcaacatagattcagtggaagcgccgcttccagttcgagtcctggtgtctcttcttcgaactatagtaccaacgctccttcttcacatatctccactccaacatcacaagctactcctgctaactcgggaatgctccaatcgaagttctcgtaccctgtattacagcagccttctttgtcgcagttcactgatcccaataacactacggtgttcatcggcggcttgtcaacattgattactgaagatgaattacgttcctatttccaaccttttgggcaaattgtatacgtcaagatccctgtcggtaaaggttgtggttttgttcaatacgtcgatagaattagtgcggagactgctatctccaagatgcaagggttcccaatcggtaactccagaataagactgtcttggggtagaagtgcgaaacaagctgctgccatgcagcaagccatgacgttagcgttgcaacagcagcaacagcagcaacaacagcaacaacagcaacaacagcaacaacagcaacagcaacaacttcatcattactcctatcaatcgcagccagctatgccaagtaactatgcttatactttggactcattgcctggtaatgattacgttcctatctctcatggctcttccgcgtaccagcactatcactcgcaatctcaacaacaagtgcctcaacaccaacaaccatcgttacttccatcgtacacctcgttggagtataatacttcaggctccatgaacagttccatctccggttcctctagttaccagctgccaatgggttcatctacttcatctctaggatctatctttgctaatcaaaaaggtggtactagtatttatcagcaaaacatgaacctcaactcacaacctcaaaataaccaatctccattgttcacttccagtttgagaccacaactttctccgcaatctactgacctttacacccaaaaacaagtggatgtgatcgattttttggaacaaggtagtaatggtaatggttatatctttgcttgatttttcaattcatttcttaagcttacaacacattcttttttcaattcaaatttaaattcaagaataggaaaggaccttttattcaatctttcccttttttgtgttgtttctgctgattcaccctcatttttgtacagagttccatttttgtatctattatgattgaagtctgcagctttaacacggaggaatactcagcgcaagatttatgttttttcagtcaatactaatagtgataatataagggtgattatattaaagttcaaggtctgatctacgcgtgacaagtaaatgttattgaactcttctaaagatcttcgaaactgtgaatcatatcaaagttcgatctttactgcattctaagacaagtccgaaaacatgcgtatataccattttcatttccttccatggatcgatatgatggtcttatatcgattaaaatatttactagtaactgagaatactgaatccctaaaaccaaaacactgatttattgttaattcaattccagtatcatcagaaatgttaccaaggccattttttgaacttaatctcatacaatttgtttgtttgtttctattttctttgtacgcattctacctccgcatttgtttcccactttccttgagactataatgagtggtagtaacaccaacatatgaggttccaagaggaatttcaaacacattattattgtcgcttttgttataataaaaccaagaaaaaaatactctgcattgaacaagaggaacaaacaattcataggaatctatcctattataatgtttttttttcacctccgtcaaagacatgccagttctcattcgaattatattcttcctttaattatctatcgcttcctattcgcagtttttcactaatgatgttttcccttttttgctcaacttattttttgttttcgttacagtcatgttattattttactctcaacaacaacaacaacaacaacaacaacaacaaccccatctactcacagaaaatatgccattccaacacttatatcttaacgcataagataactatatctataatatctatatatcaaacactaatatcttttattgctttagatttggaggtctatcgattttccctaatatgtgcgtacaacaaattagccgtggcgaaaatggcaaacatcgtttctattctgtttcccatttgtttctggttaccatgttgttgccaattccggttcttcctcgtgacgatgtcctgcgtcatctggcacgatatgacttaagatgctgctgcttacataacacccacactgcatgctaattgttgttaaaacacaaagacagatatatttaatacccagcctagcgtaactgaaaaccatgccacggaactagtgattgagatcttcccagatccaatctgccatcctcttgagaagaagaaatttttggtaaggtctaccggggtccttaacaccgaagactttcttttgactgcccttctgaaagtattacaccgtcacctggcaactaatactgctagatgcaacattaaatagcctttgcacattggattatttcaatggtttctgtgtaactataagcgcagtcttttgcctgtaattattaacgtattatcagcagcaatttctagtgattttatcggcgaaaactctccctggcaaaattctttaccgtttacataaacgggatatttgaccactctatagatcaactgccaagcttctgatactgctactttcagtttgcttttctctgacgttttactttttaatcaattaatatctgtcacatccagttttgtcaacatgaaaaattgtttgaaatccattaattaaccttggaaataatgacagaaaaggaagcgatgagatgctatggaagtaattaaaacattgataaccccttcactttcaacatcttctgaagagtccgagtaataatttttttagtttaaaggtgagggagcaatgtctaagctgatagtacgaccagttgaaaatgcgagtaattttgccaaagcacttgtggaaagtaagaaaccattggtggcagatcacggccaactggcgcgtgatctcaattacggaaagtacggtaccacgatgatcaagcctaatccatacaagagagttatatcacctgaacatcataagttgagaggagtccttggaagcgtgcgaatgtaccagatcattaacaaattggaaagtccatatgcaaaagtttacaaatgcccttatttctctttgcacttctatccaccagggcatttcatggggctagctaggaaaagttcaccggcggtgcacatacactatcgacaaaactatttattaaatgggaatttaccaggtggaaaatctcttgaggacaaccttaagtttttaaggtccaagtcttttggtaggatttcgaataattggaacaaagtactcggtaattccaattcattaatacctagacaatgggcatactttcgagtcgctgtgagaaagctactgcgacccgtgttttatgaatcatggaatcaatacaatgccccggacgggctatatttgtataagattgagattttctccgataaagagaacgaacaagattacaaagaacatatcgagaaaagcgtcaaagaagtttctaaattggatttgaataaatttgttttaggaaaagatggtgaaaactggattgaagaggcaaatagccgtgtaaagattaataccgtgaataatcttctacgttctgaaatggcacattttcggtacgaaagagtccccgcccaggagaaaaagcaaaaggttaacaactgaggatcatttcgttatcaaactgtggaatccttttaaccaagttgaccgtttgactttgttagccttccgccagacttatatataaaggaatgtcaaatatactattactttcatgtatatatacaaatacataaattgagggaagctagctaatacacactgagattggtattattcatggagatattattattagtcaagtgggagttgaaagtttaaaaattagagttggaacatccttttattgaactgaatatgatggaatgaaccagcagtaacagcttatcaaacctttttttgtgtaattgctcaatgtctttgctttttgattaatagaatctcattttggcatttcaagtaccgcgttctctgtctataattaacgtctcttacccttaccacccttacctagagatgcttcttcctcagcaagtaaggcttcacgttccttcttagcacgaagcttctcttcctttttttgttcttctagcagcttcttggagctagttttcttggcaccatcttcccatttcgacgcctcttcagcttcccgtctctctctttctgctctttctttagcatacgcttggtcacgctttcttgctaacccctctgctttctttgcggcagattcactgaatctcttacccatgttttttatctatatgtcttgctttctccagtgggaaaagattctctggcacaccctttctaccttaacaccaatgataaatcgcgagtttatatggacgtaggatacagtaacactggaaaattacagaaatttatccagttaatatatgtttggaccttttacttttcgacgctctatatctctagttgcttgcttgctcttctctttattttacatattctcttttcatcctttatatattgaaaatcaggttccactgctttcgaagtctctaacgataagaaacacctgagcttgaggtttgaaggggccggttctgggacacttgaggatactataaataagagtcgattaagatcatggtattaaccaacaaattacgaaccaagcatattaattcgttgtaacttttaaatctgtgtatcagtttgtgtactagatgacgtttctgtataacactaataaagtgtcaaagagagacagtgtgaagtaatgtgatgtgtgggtgttggtagacttttaacccaataatatcactcaaggatgtgttaatactctctccaagtgaacactatagctagctgtgtacattgggtatattagacttctcaggaacatgcagaacagtgtgtgtatcttacctgtcttttttccctttatttttatagaaaatgggtcgattcgtgcttacttagaatcaagaatttgggtttcagccattttcgccaactgcgaagtacatcttgtaaagatgaagaaagacacagtatcagtatacctattgttcccagatctgtcaggggtaagcattaaaaggagaagttcacgtcttttcataaggacgctcgaattgtggtttctaccaactgattttctagtacggttaaagacgtatatttttaacagcagcttttaaacgccagggtttccgatatcgataacgcgaatggttccggaaaccatacgctatgcctcgtttgctccgtaggaaaagggggaaagatgaagtattggatgttaaccattcccgcaattcattaactttacaagttcaagtgcatcaagctcggaatttcacgataaatgaagctgtttgcaatccattgtgcttggtaacgttcaataacgttaccaagaccactaaaaaagtaaagaatagcactcaaccacaatggaaatcgactttgaaattgaagctatcgaattctccgttatctcaatacctacggttaattatttatgattctgataacactaatttcctatacttggcagaatgtaagatttcaattctaactttgttcaggactagtagaacccattttaaattcactaaagatgcacagtggtatcctatgttcaataggaacattttgagggagaagaatttgtcatggatggatccgaaggcactgccgtataattttggggaattgcaattatctttcaaattgacttctagtaacaatgatgactcggatacattgacaagcttccatctgtggaacacgaaattgatgcataatgttgattatgaaattatgaagaagggtgtatttagcgatgatgttatagaggatgaattggactttcaggacgtcttagatgagaatgaccttctggacgttttaaaggttgatgatttggatcaagatatggaacttgccatggatattagtaatgaggatgcgttgagcgtagatgaggaaggggatattatgggagaagaggaggaagcagcactcatagaagatcctgaaatattcgacaccatcggtgccgtatatggacttgataccgtttcgttatcttcaaatgcctccgtatcttcttcctcatcttctacttcgtcatcgatttcagaaacaccttcgatatcatctctgtattctgttgaaaagggtatggatgaaaacctagcctcgttgaacgagtttcatatttacaatggtttcgattctactccatcattccctcgtgaatatagtacgccgaacgaatcatctgcatcattgactcaagatcaagatggcttcagggatgaagatgataaaaagttactaagtagaagaaggaaacgaataccaaaaagaaaaagatctatccatagttttgaagtatcaaagagagaacattcattgggtgtagtagttatgaccttgaagagtattacaaaccttccattggttaagaagaaaatgtcaaaaacaggctatgatatggatccgttcgttataattacatttggtaggagagtgtttaaaagctcttacaagagacatactttgaacccggagtacaacgaagtttgtgcatttgaagtatatccagaggaaagacacttcgaacttgtccttaaagtacttgataaggatgccttttcattccatgacaaaattgccactgcttcaatatcttggacttcattggtgggaaagtaccaaataggtgaaatcatgaatatagacttacctttgaacctaaacaagacatcagacgaacataattctgttgcctccttgaatttccagtttttgccatacagcgagttgaaaagacacttctggacgaactcattagattcacttacaactcaaaaagattttgacatagtggaacttggtatgttgttggaacaaataggacaattcacatctaatgaaattaatgagttctttcatttttacaacaaagtgccctggtctcgtgagaaacttacaatatctgagcttgttgtctatttagagaattggactgaaaataataaaacttcttctccgttcaacaatatacaaacgtgtcccctgtgtggtagaaaagttcacaaatctagaaatgttgtgaattctaaactaaacaaggaaaacgacttgattgcccactttgcgatttgtcaattaaaaagagcacactcaagaagaacatttttgacaccatcatacgtctccattaactcagcatcgcgcaggtggttctcaaagttcttaatcaaattaacctatgggaagtacgctttgggttcaaataatgcaaatatcttggttcaggatagagattcgggcatcattatagaggagaaaattagtgcacatgtcaaggtcggaattcgaattatctataatggaaaaggtgttagatcaaagaaattcaagaacttgttgcgtaaacaaactatcaaacaggggaaaaagtttgatgcaccatcttcggtaaaatatattccatcattcatcaggttccattcgcttgatatgagtgaatgtttagaagtcgaatacaaatcatttaatgacttcttctacaggaaactaaaacctggtagcagaataccagaatccacaattccaggtatcctgctttcaccagcagattgcagggcaacagtgtttcccacagttcataaagcacaagaaatttggatcaaaggaagacagtttagcgtctccaaacttcttggagattgtcctcataaaccgcagtttaccgagcacaactctagtattgcgatcttcagattagcaccacaggattaccaccgtttccatgcaccatgcgatggtgttgttggaaaagtatataacatctccggggaatactacaccgtcaatccaatggctattagaactaaacttgatgttttcggtgaaaatatccgttgcatagtgccaatcacgtctcctgaatttggaactattctatatatagcagttggtgccatgatggttggttcgatcatattaacttgtaaagaaggtgacacaatcgtgagaggccaagaaatggggtatttcaaatttggcggttctaccattatcgttctcgtccctcatcaaaaaatcttctttgattcagatcttatcaaaaattccgatgagatggtagaaacattgttgaaagtcggaatgagtgttggccatatcccatctcaaccagagcatccaagaataaagaaacacattgaagacaaagtagaaatcgaaaggatcaaaaggatcattactgtcactgacgaaaatgtgtctgctttaggatcagttccttgggaatacgatcagctcaaaaatctctcaaccagctaattaattttcccatccgaatccactttgcaccgtcttcatcgtccttgttattgtcaattcaactgtattcgaaacttttaagcttgcgtttctcccatattcctatataattccatatatatatatatgcatatacatacgcttacagtcacgtgagtggtatttcttccattgaaaaatgttatacgcgtctttaaagacgttttatttatttgatgcaattttattagatcgacaactttgatgatgaagctgcacaaggaactaaggtacacagagacggctgaacttatcaatggattcattgttgaaatcattctcgtatgttttttgagtttactttagtaaatcacttttttggcttaaggtaaagtactaacgaataagtcacaattcagtcagcaaagaagcgaagatgacattcaaaccgtacgaagttctgtgaatgtcaaccatgacagacctaatgaatacgctcttgatatgaaaaataggaactatgatatgcaattctacaagatgtatcaatatcgacttaacgttttaagaaaccgtgtggagagctgttgccagtcgaagtggaacagcgagttccgacttcaaggtagaaaagtcgtcaaaaaaagcaaggtattagatatacaagctggggaaccatgctggtgtattggcactgtgtattgtgaaatgcaatacaagccgaacattctgcaggaaatcgtcgatgacacatatggcgcaccagacttaatcaagagctatacagatcctgagggtactgacgagatcatgttagatgacgaaagtggtcgagttatcttggttggtgagctggtaagaaaaacaccttttgtgagcggtacagttgtgggcatcttaggtatggaagcagatgcaggaactttccaagttttggatatatgttatcctcaggctctaccgcaaaagtcacttccaccgttaccaggaaagaaaattgcattgatatctggtatcaacgctacaccaagaagtccaattttatctttaaggatgcaattacttcaggatgctttgaccggtgaattaagtacgaacagcggtctaaatgaagtatccagatgtatcattcttggaaactcgttaaaccctggggaaaatcgtcaagatttaccaggatcgctgagagaatttacaccattcctatcgaacatattgaaaagtttacctgtagatcttcttcctggagagaatgatcctagtgacaggagcttacctcaacagcctttacataaagctcttttcgatgacgcattgagcccttattttgatctagaaaatgcagacatctttcactctgtttccaatccttactggtttgatatagaaggattgcagctgttggctacaagcgggcaacagataaacgatattacgaaatatgtcattccgttttatgaagaaacaaaatctctaaagggggacacgattgatcacagactcgatttagccgaagctacattaaaatggcaaaacatagcaccaacggctccggacactctatggtgctacccatattcagacaatgatccgttcattctcaaagaatggccacatgtatatataattggaaaccagccagaatttggctatcgcaaaactcaactagagggagcagtggaggtgttgatagtctcagttccagagttttccactactggacaatacctggtattagatttggatagcctagttccagaagtccatacaatagctgtgtgactttatagattattatttacatggattaacttcatctgtactatttattattcattatgaagtctgaacggcactctttgtatcggaacctctttgtgtctctgattcgtggtcatgccataagagtcatcagagccatagctagtataactcaaagtccttctatcagagctaacatctaatctgtttagtagcctttcggcaatgttgggaattattggttgtgaaaagatcaggctaatcctggcagcctccattgcgctgtaaacgatcaaatccttttcaaggccctttttagaccaaggttcggttgattgaataaaactgtttgcttcgttaataatgttccataagattttttgggcgccagttatatcgtattgctggaaacaattgttaacactctcagtgcagttgtctagactttttaataaagcggtgaattcagcctgagattccttagggaagaccgaacttagttcctcgatgggttttccagaaaatagttcaactcctgaggctagagagaatttcttaccgccgcaacggtttatcaagttacccaacttcgagcaaagaagctccctggtttcccacaggtttttttcaataaagtttccatcactttcgatattagagttctcaagtagataccatcttgttgtatctgctccataatatgagataatctgaataggatccaccacgtttccaagacttttactcatcttcactcctccacttagccaatggccgtgaacaacaactctgtttggtaaaggtaatttcgccgccaacaagaacgcaggccaatatactgtgtggaacttgataatatccttgccaataacgtgttccgtgttttcccaccactcttttggcttttcgataaaacttctgttattgtgcaaaacttgtgtcgagtctacgtcatttctaattgcatcgataccaccaatagaggtaaggtaattacatagcgcatcaaaccacacatacactttttgagattcatcctctggtacgggtataccccattgtagccgagtcgcaggacgcgatacagatatatcccgcagttcattggattcaagttctctcaggatttgcgaatgtcttaaaggaggataaatgaatgttggattctctcttaataatttgatcaatggttcttgaaacgctgatagcttgaagaagtagtttagttcagattgatatgtaacctcgttcctagattcggagttgatgtatttagcatcaggatcgaagctaccgtcatatggtattggtggaccgtcgatagtcaactttaagattttcgtatctggataaaatgtctcatcagaaacagaataccagcctttatgctcccccttataaatgtacccgttattgtagcataggttccagagctttttcacattatttacatgatctggatcagtggttcttatgaatctggtaaacttaatattagcgtccttgtctaaatgaacgaaatgctcgcacaactcatcaacaaaagctttgggattactgtaacctttctgctgagcagccagttgaattttcaaaccatgctcgtctacaccggtcgtgaagcaagtatcctggccggcaagtttcttccatctattttgcacatcacacagtagactgctgtaaaggtgccctaaatgaggttttgcattgggataaaatattggagtggtaatgtgaaatttcgataccgctcgtaccgctttagaagtcatacttggcaagtgaaagagttgctagttgttgatttcgttctgcagtgtttattcttgtttgtcttttctcataatgttcggtataaagatattttcagaggttttgttaaactaaaagtcagttttcctacgttagatattcgatcaagaaccttcacttaaattagaaaatgtgaacggttatggaggcatatatacttatttgattatgctaatacatccataaattagtacccatttgctggaatatctcccaacaaaagtgttaaatataattatttagtgaacaaactgacaacgtcctcatcttggattttatgatttagcccacatttctgtggggaatgcttagccgatgaaccccatactaaggcgtacttgaatttatctttaaaatctctgtgaatattgtggcaaagatcacctatggagctgttactcctaacaaccaatgggtctgagaaatctggctttataccacgcttctttgtatatacacggttcaaatttaattgataccagatttcatctaccacgtcatccaatcctaagtcatcctcacatgacatgaccactgtgtttggttctcttgctagtctatctgcttcttctaatgagacagcatcaattttgttgtacacgtagaggcatttgatataatttctatgctgttcgttaagagtatcaatgaagtcatcaatggtacattggtcatcacgcactaagacatcagcattatgaatacgataatccctaagaattaacttgatggcatcctcagttaaattggatttcgatggggatgtaaatgtgatctttataccaccggtttctttctttttgaagtaaatgttcggcttctctttattcaaacggattccaactgcctctaattctttttccaatgattccctttgatgcgcacccttcgtagcatcaagaaccatcaagattaaatcagctgttcttgccgtggacaccacttgtctaccacgacctttgccctgagaagcaccataaataatacctggtagatccaccacttgaatctcggccccctggtacttcaatacacctgggacggacgttaatgttgtaaaagcatagtgtgcaatttcagactttgtggatgtaatcttacccaataaagatgacttaccaacggatggataaccaatcaaaacgacacgagcatcgccagattttgcaacctcgaagcccgatccaccgccagaaccaccactacctgcctcatctgccaaaagttgttgtctgtatctagctagcttacccttcaataaacccaaatgatgctctgtagctttattcttttgggtacgggccatctcttcttcgatggccttgatcttatctataacacccatggttgttgttttattatgtataaatcaccgattcttccacctctatttgtcaggagcaacgctactaaacttcactcagataatattctgacagtctgacaatatttaatttggtattgccctaaaccctaacactttgtttgggactaaaagttgaaagcttctctcaattcatgcgatgcctttctggttctagtcgaagctagttttttctgtcaaagacaaatactggaaattggttaaatgtaaagataaaaatacagaaatgttgaataggatagataggatgctattaggaacctacatttggttcttttgtagctagtaaagtacttaaagcaggtttatgaggccattgaaatcataagtggcttacacagcttaattttagccatttgaaacagacataacacccttacattacatattaattcgacatgtttttccaattacatgtcaaccaccatgaaaaaaaaaggaaaacaaaagtttgaatctgaaccttttctattgccgtgaaaacaatgaacaaagcagacagataaccttgataaaagccaagcaaatccagcatatatcttaatacgttgagcatcacaagcaaaattgcttgactttgtgtttttgtctttcctctcctggaccaataaatatcgaataaaagatgtcatatcaccaaccttcaattccctccattgatgcaaatagtaacacgaacgggttttaccagccatcacaacagtattcgttccctcaaggatctatggcttttggaaatgggatgcagggatctggcatggatttcggtggcagtaaacctagtggtacgccagctaatttcacaaatgagcagttgacaccaggtctttttaatgccttatctacccgtgggtattcattcgaaccttctttgcttgaagaattgggaatcaatttcaaccgtataattgctaagacaaaatttgtgttagtaccgctttctcacaaaggtttatcgaaagaaatccaggaggattccgatcttgctgggcccattatcttttggttaatgttcggaatattattacttacagcagggaaagtacattttggctacatttatggtgttgcattgtttggttctctgtcactacatacacttctcaaatacatgagtgatggtgcccatcaactgcaacaacaagcttctgctgctggaccatcctcctccggaatctcgtatctgagaagtgcatcgattttgggttatgctttcctaccactctgtgtgttggcctcacttggtgtatttgcgaacctcaacaacacatttggatacattctaggactattgactgttctgtggtcaacctggtcctcatctggactattcactgtatcattggatcttcacaacgtcagaatcctaatagcctacccactgctaatcttctacagtgtatttgctctcatggcaatcttcgtataaaataaaatgacaagaattgacatgtaatgacttcttacatctttctggtcccattcgcaagataaatatgactacatactcactagcatgaaatagattattatcaatatcttcaaattgatccagactcggcagtttcccttaatagtgagacaagaatgcaagggtcgacgaggtagtgctgatatttggattggtaatcaaaggttgcagacagttgcatcttcctaataatgaggttttgtctttcttccgttattcgaatatgggaataaattagtacgactgtttcagaaagtaccttgacagttaaatgagcatatttaaatgagagctttgatagtacaacaatatgctttttgcgaacaataataacaaagactgccaccgccagcacttgatatcattagtaatgagtcggaaataagagagaaccaatttccgtctgcatgtataaataggaaccgttacatcaagtatggttttcgggatttcggttagtgtcagatacaaacatatggagcatacaataagcataaaagacgcaggaatacagtggcacatacatcgtaaaaacttattatgagcaaggagattaatgatttggtaatcattggaggcagttatgccggcatgtcagcagcacttcaattagttcgtgctagacggaaagtggtgatcatcgatgaaggtataagaagaaacagatttgcaaaagagtcgcatggattcttgggcagtgacggtgcgagccctaatgagatagcagctacagcacgtggacaattgttgaaatacccaacattacaatggatcgatggccgtgctattagtgttgaaggaacgaaagacaatttcgtcatcaccactgcagataagcaggaataccgtgcttccaggatcttgctagcaactggcatccaagactgcttgtcggatatcgaagggctcgaggaaagatggggtaagtctgtttttcattgcccatactgccacgggtacgaattgaatcagggaaacattgcagtaattgccacgtctccgatgtcaattcaccaagggttgttgttgccagagtggggcacaataacattctataccaatggtaccaagttcggagatgatatgctcaatgcgttggaatcgaaatctatgaacgttgtccacggtatcgttcagaaaattgaaaatgaggcagacgttatcctggaagacggttcaaaagaatcattcactgggatctttgtttccactaccgttaaaccgaccgctgatgagttaatcaatcatttaggctgtgatatgttaacgaaccccttgggatctatcgtgaagacggatgagaagaagcaatcatcaaaaccgggggtttacgcatgcggtgacgttggtgtatttccgagcaccgttgccttagcagtaggtgacggtacactagcaggattcaacattcaccgctgcttattggggatgtgaattatgtttcacgtgaattgcttctgccatgcggtacaattttaaatataattcaacatcgcactatggttgtgtggccgagcggtctaaggcgcctgattcaagatacctatcttaaccaaccttacagttgggaacactcaggtatcgtaagatgcaagagttcgaatctcttcgcaaccattaatttttttttagtcctttcaaactttttttttatgtattctgcagtatgttcaaccataatagcattaatcatagcttcctgtatttgtgaaatattccgccgggctggaaatcaactcattcattcatcatacctaaggaaacgtcacatcatcagtcgcactctgttggataaggtgacgcgtaaaacagaaattgcaattacaaattgtaaattttaatatattctaaaatgtacgcgtattactgtagtatccacgtagtaatctcgaaacataaaagccataaaatcaggtgtcatttacgcgtttgtttacatttgcaatgtttactaaacactacattacaccatacttccccgtcatatgccgaagccacccccttaactggcatgatcattactcaaaggcaattagggatgtgtgtattgcctcaaaccaaagcaaatacgtttaggttttagttgtacaacggtttgaaacttgtggtattatgtcacctcgtatagcgcaccctcttcccgagaaacacctaactctactcccaataccagtagtgtattgacggtttcttatacaaccatttacataatgaggcccattttatattcatgcatcggccgcagctgaaagatggtaatagcagatatactcgtagtagctgctgctgcagcagctgctgctactaccactgtaagtttgctggctattcctactcttcctgcccctaattcctgcccttatcctattcacaaacgcgaaacgcgaaacgaattaattaattttatttaattttattcagatttcatctgaccctacaatttgcaattttggttttggttttccttctacagtagataccgtaatccattgtcagaagatacggaaatgagaaaaattttcctccgtcagaacaagaaaggcctgcagcctgtagtttgcgaggcagatcagatcagatgagggcaggagaagtctgattagctgtgggtcgttcctttctttttaggttatcgagaagtagtatataagagtattaaaatatgccgaaagattcttggatcctgagtgtcgagtggcatcgcatgatgtgttatcagaataaactttgtatgatttaatataagatagattcctttttttttcactgataaaaagtgtttagagtaaaagcatcgtagaatcatcgcttctcttctgatattatatatatagaagaaagaacaaggaaatatcttcaagacagctggtaccctttttctgtctcgattcaaattttaagcttacaacacgtacggctatatcactaagactaacataagatcaagtgaatgtcacctataatgaaggaaactccatcaaaagcagccgcaagcgcactttcagatttagaacttggcgaagccaagaaggatttaggatcccagttaggagctgttaaagaagagactgctgctgatattgatatcaagattgccaaggctgtagaagaacacaagaagtttatcaaatctcaccatgtgcatcgtcataaattgaaggcactagagaaggatgagcctttgctagttgagaataagcgtcgttttgttctcttcccaatcaagtaccatgagatttgggaagcatataagagggccgaagcgtctttctggactgcagaagaaatcgatttgtccaaggatttgcacgattggaacaacagaatgaatgagaacgaaaggttttttatctctagaattttggcgttcttcgctgcctcggatggtatcgttaacgaaaacttggtggagaacttctcagctgaagtgcaagcaccagaagcgaaatgtttctatgggttccaaattatgatggagaatatccattcagagacttattccttgttgattgatacctatattaaggatccaaaggaaagtgagtttttgttcaatgctatcgaaactatcccacaaattaaagaaaaggctgaatgggctatcagatggattcaagatgatgatgccttgtttggtgaaagattggttgctttcgctgctgtggaaggtgtgttcttctccggttcctttgctgctatcttctggttgaagaagaaggggttaatgcctggtttgactttctctaacgagttgatctgtagagatgaaggtctacatacagactttgcctgtctactctttgcccatttgaagaataaaccaaatccagaaattgtggaaaagatcattacagaagctgtcgaaattgaaaagagatacttcatggatgctctacccgtttctctattgggtatgaacgcagacttaatgaaccaatacgtggaatttgtcgccgacagattattggtcgccttgggtaacaagaaatatttcaatgtcaccaacccattcgatttcatggaaaatatctccttggctggtaagaccaactttttcgaaaagagagtctccgattaccaaaaggctggtgtcatcgctaagtcttccaataccgaagcccaggatggtgcttttgcatttgatgaagatttctaaatcttgtttgttacggaatcttttctatctcttctatcccatgcggaatatctttgtcttcctttctcttacgtatatcattttatcatataaggtttttagtttactcttttcatataactcactaatgttaatactttaatgcactactcctcgcaatcatctcttccgttaggaatatgctacggtactgattataactacagctcatcttcaatcaatttggatctggtagttcgtctgttccttgtaaatagttattatgtcaaataacacatagaaaaagagaatgatagcaatcagtttttcgcagtgaatgaaggtaaaaatgcagcggggagagacgcaacctcaaactgtaaggactgttcattgctagctttgggatatgtccaaacgatacttggatgatgtgttatcacctgacactggaactagcgatagtgactcttctatcgaaaatctaaatgctgataattatagaatagacatcgttaatgacaatgcaagacgcgatgacattgatagaatacagagttcaaatcttaaccatgagccgccgtataatctagaaggtgtatttgcaatagatgatgacgaacatggtgacgaaatggtacgaaaggactcagatcgcaggcaggacataacagaagataatgatgattctttcgttcccgatataactacacctccaagagaacgcaagcgcgtacgattcggcatcaatgaaaagggtggcgatgaagaattcaataatgtcagcccatgggatttcaagcggctgatacggaagttttacaaagaacagttgccagatacataccagataagaaattggaaaagaccttcaaaggatatgttaaccaatttcatcgatttgattgaaaacaatatagaattggcctctgaggaagtattcaagcaataccaccaagaattgaatcaattatatcctgatagcgaagaacaggctaagttgaaggatagccttgagaataaagttttcgataccacatataatataaagaagaggttaaagaggacaaaagtaccatcaaaaatctgggtggataacttgaatatggaatatatctatgcgaaaggtgaatcaatcaagaaaagatacaagtcagaattggacagagctgaggcaattgagaggcaattgattagagaagaagaacatctaaaatctctgcaagaaaaaggtgaaactcaggccaaaaaacgaaaacaagtcttgagtaaggaattatccgagctttcaaaaaccatgcatccatcattatcagtagcgttgtcgaacacttttggtttgataaaagacgataaaatgtcaaacgagatctatcagcaagataaaatagatttcaatctaaaacttaagactgatttctcaaaacctctcatatctgaaaaggaagagaactcccttaacggtttaacgaatgcaatggataataatagagaacttgttaatgaaatctttgggaaaatatcggcccttttacaaccaaaaaagaacagcaatgagtaggataaagtgacaagtaaatatacattcactgttttgtaacatttaagagctatattgtaataataataataataataataataataataataataataataaccacaatcgacaactgacgataactacggcaggatgggcctctacaatgcagatctctcctttcgataagtaagcgtgcggtttctgattaaatagtgtgtcagtcgtccctttttacaattgtagagcaagcaccgctaagttgaaaaccaacaaggctgcaatcaataaactagaagttaaagctgttacatagcctcgatggctgatgttagggagcgtaccatcgtgtatcttcccttttatagctaattattatcgaagtgtttagtcacatcactgtatacgcaatagtatgagcaggccttgtctagaagaaactgtgtaatttgacaaattcatgaaaccctcgttttaaagatatgcaataacaaatcttgtaatcaatggatatgatcaatatcgaggccaattagtagcgactcaggtttctctataccaggcttcagcaaccgatgagaggtgcttcaaagaagagttctggttcagcaagttccagcaaatcccgtggcaatgctgctttcaatggaacatccagttcattttatgaaactgcttccgtgaagaagagttttgacgaaaggcaggactttttgctggtgaacggtattggtaatcgtgccatcgttactataacttctggtgttaagtatgagggtttagtagctgcttggaaccctcactcatctggtaagggaattggtgtggttttaaagtatccgaaggttctagataaaggtttcgatgagtcggatatcaatgctctttcggcagaattaagtgaaacgttaaccatagaacctaaagatgttgctggagttaaactatttgatgttagcttagattcggatccattggcagcaaaggaggaggaatcgaaccctgttgaatcagggaaacaggccgcagaaggcgagacctcacaaaaggatgcattcaagacggacactgctatttctggagctccaaaggaactgaaggaacgtgaattgcaaaaatggagccctgatgaatcagaaagctttccattgaataatacttctttagaggacgacaatggtacctgggatcagtttgctgttaacgaaaagaaattcgggataaagccatcctttgatgaacatttttacacaacaagaatcaataaggaggatcctgagtatcagaagaagctaaacgaggctgaaagaattgcaaaggaaattgaatctcaaggtgctagtggtaatgttcacattgatgaggatagaaacattaaatatgatgattctggactggatgaggaggacaaatattccggtgtcgatcgtaggggagacgaattacttgctcaattgaaactaaatgccaagccagaggctaaaggtgttagatacgttcctccctctctaagaagccagccacatcatgcggatcctgctatattgtcaactactggaaagtcaaagacttccactagaagcgagatcgctgacttgaagagcttttctgagaaattcaaaattccttatgatatgcctgatgaagtaaaaactattttaaagaaggatgatcaacatgtgaaggagaaggaggaacagccaccttccagtgcctccgctgtgtcaactacagcttcgactccatctcctgcgccaaagacttcaagtaccctgaaatccaatccatcattacctcctaaaccagcctctcaacctccaaccaccccaactttggcaaatgcttctggcggcaagggttctaacagatcctccaaagcgggaactccagcattgggcaaaattgaagttagaagaggatctcaaaacaaattcaacggtagtggaaagactccaattgcatctccatctatggctagggcagagacatttggtagaagacgccaacgtaatttctttgatgaagggaagccaaaatgtttgaagaaggacttgaacaaaaactttaatatgttcttaaaggcaaaagaagcacatgaatccaagggaaaagattctgaaggcaagaatttggaacgtttcttcatcgaaaaaccatatttcacctctcctacatgggtgagtactgtcgatcagtcatacaaaagcctgttcccggatgagagaactgcaattcaaagaactcaaatgagattgcagcaacgcagcatcgacatgatggctcaaggtatggctacaggccctggaggcatgcctatgggtatgcccgttggtgtaccaacaggtggacctcctttcatgggtggccatccgggtgcaacagcaggatcacatggagggatgtttatgcccttccaaccacaaccaatgttctacccacctatgggcggacaaatgatgccaatgatgaacagcagaaatgacacaagaaatggatcgggagctaacagtcagtcttcatctccaccggcaactacgggatttatgaatggagtacccatgaacgttccctacggttaccccatgagatatcagacgatgggaggtccaccacttcaacaacagcaacaccagcaaaagcaattccatcagaaccataccagaaattacagacagcataacgatagtcgttaattcgaattagggctaccattaaaggattcaattgtatccacttgttcgtttaacttttacaaactcatctatactactacataatttctgtgtaaacaggatacaacaaaaataaacaacttgggtaaacctcgcagttgagaatctgatctaatggagccataaagacgctacaaaagtcatgaagggtcttttaaaactgcatcaacttttatgacttatctttgtcaagttttctctgcagtattgtaaagaagaaagaaaaatagagatcacgatcccaaggtaaagtaagaaactcaaattaggtaaaagctcatcgcattaaagtaaaggtttgaaagtatcttcgggctgtaaccacataactacccgtttatactgtattaggcgaactgaggctagatgtcaacctatataaaaggcccaatatgtggtgttgacaactgtaggagtcgattatggcgtataatagatggtagaaggacatgtcagtacggtcatgttatggaaggtgatgtggaattcaatgatgatgaggatgatgtgaatgccatgggtgtggtaactagaaggttgaatctaactacaaatgctactggcaactttcagtcaagtttaagtctttctcaatcacagaggtccacactgggatcaaacaagacagaaaaaatatatgggaaagatggacggttattgttcatcaagtgtttccagtatatcttaagaaagcagactgagtggcttatagaaaaggagaattttccaaattcttactcagatctagtaaaactgatatggactatgcatttaaaacacatcgatcctgtgttatttgcggacaataacaacgatcgtttaaatgggcatgacagcgatgaagctggcgacgatgacgacggcaataactatccagtttcgggaaaaaggaatgaagtgggaaggctgaagttgtccatgctatccagcatatctatacattatttggcatgtctacatttggggttgccaatatttacaaacgatattcttcgatggatatgcgtggatggattaccgtatttcagatctcaccatatactaccgaaggaatggcaggataaactaccaaattactacctactaatccttgacggtgggaaaccaccgtgcgaactacaacttcagcataaagtggcacaatgtgcccagataattaattttaaaacgcatttccggtccgttataccggcgcctgtactactactcagacttaccttgatagaaagactccctggggagttctacttctattctaagcgactactgcacctattatacgacaatctagaaattccaatcctaacatatgaggataatcattaccgcagaccgcaccaatacaccgatatcaaaatttgtagcgtattcatcgcggcagttaaacttcaacttttggcggaccaacaatccaaagctgataacttcgatgcaaacttcgcatctggatggctcaatatgatgaaaagaactgatgaaaacccgaaggacaaattttcaaaggccaaacttatcttcaaaatgacatactcacctgcatcttcactagtcgacagcaactccgagatacaatcggctgccaatacgacacagtatttggattggatagaaaaaaatctactctctttggaagaaactcatctggaatcaacgcaaacgcttgatgagaaaatcgccaacagaaaattgcataacattatccctttaaaggcatccccggatccttcatccggagatattgctttaattgaggacatacaaagcggattattagaatttcagtcgctatatgatcgaaatgcgaatccgggaaactattactccatattcgagatggtagacaagattacccgtgacctttctctacatttcggtatcagccatgatcagttgagggcatccacggaacatatcatacaaaatatcgaagaaactatgtaggacgtccatggggaatttatacggaggtacgtgtgcttattgatagacattgtgccaattggtcgttctttgttctaaacgtcactaaaattccgatggtagttttcacaaccactgtcgtttccactttaaacgaacgattcgtacggtctcgtctataatagaaataaaggaattgaaaaatgatgcaaaaacttttcatcaaatgtataaatatccaggactataacttccatcacctcttgcatgatatccatacgttgatatttaatacgtagtcggtctattctaaaacaacttccatcataggctcacataattgaactctttattgaattgtttttgttcgagcttcgttcccataatatgcacaaagaaaataaggtttcttaaggtttttgattcgtcaggcatcgtgcatcattcagaaacagtatttcaatatcaataggaatcacacaacgaaccgcgattctattattagtggaaaggccataataaacaaatgggttcggtgtgtttatcatcaaaaaagttagagcgcggccatgccagacgtgctggttatgttgaggaagtcttattgatggaacatcgtcaaaaactgtactcgaattttgtagtgcacggtgagttgaaaagtgcagcttctgagttgcaattggcccatgccctaagggctttgtttctaaggtatccgatacttgctacgactatcattccagagtattggaacgaaaaagagacgtattataccagtgaagcattttacaataaaccgggacttgcagaggattacgttagtgtagtagatcaattgaagcttgaagatgtgatcatgaacaagcaacctgaacattccaaattttataacgagattttgaatcaatgggaacatgatgggttcaaatacggagatgatttgtccgtggtcgtcagtcagtacactttttcatgttgggatccaacgaaaccccatttcagattggtgcttttgccttcggcagatgataagaagggagcgaggggattcaaggatattctttacatcacgaaccatgttacaagtgatggtacttccggagctaatttattggaagacttatcgatcgaattgggtaaattttctggaaccaatttgcaacagttagagtatcttttacattatggaagagactacgagcaattgccgaagttaccagacccaatcgaagaaaaagtatcttatggtgtcaatccatcgtttattgcatctttcctcttgagtcaaatgggaaagaaattgttgaccaagaaatgggaccaacccatcactcgtcctatcgatgcgtcacccgctagtcacatggctcacattatcaagattgacccaacaggtatgcagaagatgagagctagagtgaaggacaagttgaatggtaaagctacgttaacgcccttcatgcaagcgtgctggtttgttagttgctatgaagctgggttgtttgacgatagaaaatggaacgaatttttcatcaacatggcagttcctatgaacactagacaatatctacctgaagatcccgaagtaagagatcgttttagatatggtaccgttgtaggaggtaccaatttcaatttcctaatctcttcttttaatatcacaagtaaccaacaattctgggatctaaccgaatattaccaacaatggttcacgaaaactagagaggaagggctagctacaaaaacattcggtacgcttttcgccgattttgttagcaaatccaataatttggataagttaatcaaacaagatatgatgcatcagagaagagcatttgcacttttaagtaacgtcggttatcggccacaaaaagcacaagagagcaatccattccaactacaagacttgatcttctcccaagcagcatgtgaaatgccgttcgtgtttagtttgtgttgtgtctctacagatatcggtggtatgtcgcttaccctaacatgctgtgaggaatcaatctctcaacagcaatggcacaaaatttgccaagtcttcgaaaagaacttgacaactttataacgtaaatattcaaaactttaaataaaccgatgataatcctatcactggagcagaacgctcagcgaatattccatatggtccacatgtagacatgtgacgaacaaaaaacgagacagtgaaagaaatcaatccggcgttaaaatcaatcctctgtaatgcagcacacgtcgtataacaacagaatacgtgctccgaaatgttatacggtacgtctcgtccgatctaagcccttcacacctcatcccatgtctttttttatcgtattttatcgtattttatcgtattttatcgtatggcatcgcatctcatctcatcttctcgtaaacaggctctcgaaggaaaaaaagaaaaaaccacgaatcaaagctttcatagaataagaccactgggatcatgacagtactactaatagagtcttagctcttgagtgtctattgatagcttctacttgagaagccgcatctgctgttgttacagaggattatcaataaacgatttgtgcagcttgacggatattcgtgagtgctcgttccagaaagagaaaactaggaattgagaatacatatacagtgattatcgcttttcgctttcagttgtataaatataagggctaggtattttgaattcatttgataccttactcgtaccattcgattgtgattttatttatttattggacttgtcaattgttaccagcatcaactaaaggttgcgaacggctcaatattggtcatattctaaacgggacaaagagcgcctgtttatattcaaaacgctatgagtgattctgttgacgttaaagctattcctaaggagctccttagtgctagctcagaaattgtctatgatgccattgtcgttggatgtggtgtcgtaggtccatgtattgcaacaggacttgcaagaaagggtaagaaagtgttgattgttgaaagagattggactatgccagatcgtattgttggtgaactaatgcaacctggtggtttgcgggcattgagaagcctcggtatgattcaagccatcaataatattgatgctatcccagtgactggctactctgtgttctacaatggtgagaaagtttcaatcccatacccttacaaggccgatacagcaccagtagagaaaatatcggatttagtcttcgatggtaatgatagagttattgaagataaaaccgttcatgtcaaggatttcgaagatgacgacagggaaagaggtgttggtttcgttcacggtaagttcttacagaatttaagagatattgttgccaaagaaccaaatgtgacccgcctccaaggtaatgtcattgagatcttgagaagcaaagaaaacgaagtagttggtgctaaggtcgaaatcccaggtcgtggtaaagaagacttcaaagcacatttgacttttgtatgtgatggtatcttttctcgctttagaaaagagctctccccagatcatatcccctctgttggatcctctttcgtcggtatgtctttgttccatgcaaacattccatcgaagaaccatggtcatgttattctaggtacttcacatatgcccgtgctcgtatatcaaatctcctctgaagaaacaagaattctatgtgcatacaattcagcaagactacctaaagatataaagtcgtggttgactactgatgttaaaccatacttacctaaatctttgttgccatcgtttgataaagcggttgaagatggtaaattcagatcaatgccaaactcttacctaccagcaaagcaaaatactgtcaccggattatgcgtcatcggagatgccttgaatatgagacatcctttgactggtggtgggatggctgttggcttgaacgacgttgctctactaatcaagactgttggtgatttagatttctcagacagagagactgtccttgatgaattactagaataccatttcgaaagaaagcaatatgacagtgtcatcaatgtactatccatcgctttatactcattgtttgctgcagacaacagaaacttacaagtattacaaagaggttgtttcaaatatttcgaaagaggtggagactgtattagattgccagtaagtttcttggctggtgttcttccaaaaccgttcttgttgaccaaggtgtttttctcagtggcattgtactccatatatgttaacttccaagaaagaggcattttgggatcccctctggcattattagaggcatttgctatcctatttacagctgcaaaagtgtttactccttacttgttcaaagaattgataggttaatgtggttgctgaaatccatccgccaaagaaattcaaagatagaaatataaactaatgataataatagacttctgagagtaaaaaagtagcttcagattatttgatcctacattctctcataatgacttttttttgccttcgcttttatctatacatgtgatgaacgcatctgacagagatgttgaggatactaacttattcaattttaatatatacatgtgtgtagtaagcaactcctgggccacaccacctgtagttttttaccgtaataatctcgcttgttctatccgcctacagactccttcatgggctgtactaatccatgttctctcgacaaagctgtcctacgttgcgcttcttcaaaccactaacggtgattatttgtatatatatgttagttgttacccgcacatattagcttatggctaaagcctctggaaaaagtaattataacggagctaacctttaaaagtagacagagatgtggagcaacgctgagtttacactcttgatgagacagttaagagccgtatcacaccagtgaagcgttgcatttatcacgtttatttattttttagcatggagtcttcgggttttttacgctggggtaaagttttcgctgcaggaggcagtattatattaactggtgtgcttttattcaaatatacaacaccaaccgatgagcaactccttcaagcattatcaccggagttgaggctacagtatgagagagagaggaatctacgtcaagctgagcagcaagaactaatgaaagttgtacagcaaaccatgaagagtaaagatcctatttggaaaacaggaacggtcgattcaccatgggaaagaaatggaactcaagccactaaggaccagttccaaagattgaaggcagatcaagttcagaaggaagagttggaacggatcagacaggaattggataagattagaatggagagtctggaccaaacagatatgatcgtttccaaaaagagctggtggagtctgtggtaaatgctggtattctacgtttcgatatcggatttctctcgaaaccgagtttagagctcaatttgcattattttttcctcaaactttatggcggaaaccaatccatccacgttgatgaatcggttatctgaaagttactttactaaccgcctgtagatattatttatcgttgttttcgaaatcaatggagtgtatataatttttccatgagtttcgactttatttattcatatgatattattataatccactattaactattatgctgcaaggcctatcaacattaatatgacattggcgttaagatagcggggttattttctgatttatcattgatgtgacccccaagcactgaaatttgaataactgaacgcctggaacgcctcagagattcgattccctgctagtttggtgaaagaattttcactttcattagcgttattcaattcatctacagcacttacgattttccttacattggtctctatcaccaatccaccttggataatctcttcaagtacactttccaatgtttgccaattgaagattaagtctagctcattcacttcttcgaaacatttatccaatgcctctacaaacgtttgaatcaaatctaagattgctagttctgattcttgttcatcaactataaatgtgaagtataacgtggcgtagttcttgtatatgatttgaatatcttcgttatcacctgagtccattaataaagatggaggagttactaagaaagatgactgcacctgactgttacgctgagatataagttcatatacttgctgtaataaaagcgtttgcttttcaacctctacaggtgtataaaattttatcaatcttggttgacatttcttgttaactgttgcatttggatcatcattaaatgttagtaaagcttgatttctagggtattgcttggtaacactttacatacatattaatactgcatgaatcatgactggccgttgccaattggtctgtgcttgtctgttatcaaaggcaagttattgaactaccttgttcaatgatatctatctactattcttcgcaaaatatacttgtaacttctcatcatcattttaacttatttcaattgaattggcactttcgattttcaaatgttggattcatgctgagaattgtaaagatgggttttctgtacaataaaagaaaacgagtaagaaacacatcgagagccgttagtgaaaccttaccgatactattgaatttgcattgaatgaatcgaaatgctatagtggattcagtttatgaaataggtagcaacgcttgataaaaaaattgagtgctcaataaattattgaataatgaaaaagaatgcatcggccgggaatcgaacccggggcccaacgatggcaacgttggattttaccactaaaccaccgatgcctagtatttgttgatgtctgttgtactaagtttggggtacagtaacgtaatgataatcatgcgactacatatatgctccgtgtgacaagtacttggacagtggttcatattagtaagtaaatcactctggggaacttccaaacatatcttccaataacgcggtaaatcgcaggaaaggagaggttgtgaaacgggctgaaacaatagttatctatcccttccattgctgctcgatgtgaaggaatgtttcttcctcatattgaaaaaaaaaactaatgatttgaagctttagcataaactgaaatatccattggcaatctacaattaacagctataatctatcatccaggcccctctgaacattgcatcggatcaataatctatcatagaacacattaagatatggctttaacttcgatctttggtggtagctcttcatcatctggtaccccagccacatccagtcctagcgatgtcaagacccaacttaaatctcaaatctctcaagaattagccatcgccaatgctaccgagttagttaacaaagtcactgagaactgttttgagaaatgtctgaatgctccatatgctgcttctcaagataactgcgtcgaccaatgtttggctaaatatatgagaagttggaatgccatttcaaaggcttacattaacagaattcagcaagcttcggttaacggtgaaatctaaggggcgcaacttttgagataaaagaagttatttaatgctctgattcattacaagctacatgtatatagatttgtataatgttatattcgcgtcttacgtataatcatacattatgaatgctatttcatacccgtcgaataaattcaggtatatatatataaacaaaagtacggtattggtacacaaataatgggtaattcttttttattatcgtatagacatgattaatacacagaaacagcacaaacaatacattgtatttaaatacaattgagccgcatatgtgattgattgatgagatttcaaataagtgagttgaaaataaataggagtagagggaaaaacagctaacaacaaataagatgaacatcaatgcgcagatattcacgctttatggtcatatatgttttaccctttttatctcttgaatcgagtgagattccgatagcgaaaaggatgaatgttatgaaaatctgagaacatcattccaaagttgatgtcctaggcctggtagacgtatggagtgccggatagataaatgtttcccgacagtagcgtatccacatttttaaaatatgttttgaagtgacggtatattctaagaagtaaaataattgaacaaaagcatcaatgaaaagacacttaaaagtataatgatgagaaatgatataattcaaatgtcaaaagaaacttattcatcgtcttcttcatcttcttcaccaccgttcatgataccacccttgatatctttccataacttacctttgttgtggttttcgtaccaagaggtcacaccagtatcgaaggcagcttggaaaacgaaggcagaggcgaacacggtaccaacgaaaacagagtttctcttaaagacagttttgtacagagtagaggcgaaagactgtgataattaagttgttcagaaaaataattgttagtaatatgatctaatatttcatgtagtcaatccgcaatgatctgggaaaacagccgctggattttgcccagaaggtgtccattcttcacttgtttgatgtaactgatatacatgcgataagccatggtcgtacttcgaagataaatgtagtattgagactgcctttctattatatggagatatcggtcatacctccagggaaccttaacaggcatcggaaacaccacgggatatgcagacattcagctttggaagtatatttcactaataatagtataattgtacattagcatctgctcaatgtaatttgcatcgtgtttacaaacagttttttcagttcccagttttcggtttctcaattccagaagtcaaataagacatctacgccaaaatcaatgttttcagatccagaaaagacgcatatcatatgtattatccatgactaatcaaatcattaacataccatttctaaaacgggagttctggtttctgttgagctgaactttttcttattaaaccttgtctttggcatcagtcgaagttagctttccgttttatacatttatccagtttttcaaaaatttgaagaaaagttccgtactcggatataattgggtcgtatggtatgatatccagaagtaatcacgtgcaaaagtctagtactgggagtactttcaacatgaattatcaaagggtgggacagagtcaggctacaataaaagattctgtaagatattggacggcatagtatcctgtggtcagtccactccacatattgcagatttatgcaaaactagtaaaaatatcttatatcgatgtgtgcataaacgaaataacgtgctattctatatatatttggtacattgaagttgtgaatggtgccataaggttaaggcaattttgaggtgtgacgagcaaaaagttattcattctacgttatttaactcgttgaaatcaaaaccttcttctgcagaactgtattccgtgtcttgatcttccgaagcgttgttttcgtgctcttcgtcctcaccatcttcattgccgtcactttgatcattcagttcaaagtgctctctatttctatctgcacggccgaagaatccattcattgcatttccttgcagttgttcaatgatatcttctgtagtcggaatgtctgcgccatcaccttgcataccccctctcatgttttgaacaaactcgaaaaaatcatgtatgtcacctctttcggttggtaatcttatagggatatctccaccgaatggtccaccattgatgcgtaattcaacatcaggctgtctaaaccttagatctggacgatcatcattcccaaactcatcatcgttcataaggtcctcgtcactgctctccccaccagcgttgaaagcagcaccaggtctccaaaacatgttcctcgtaaatgttcggttatttgccatcgcaaccctgaattcgtcccccattactcggctgatataaccggggataccatttgaaatccaaagacgagttaaatgttcatatctagcatgatttaatactgttagatcacctcgttcgatagcgtttcttcctgattcaccgtgtgagttcaaataaggggccgaaatgttgacggtacagtccggtctacttaaatagaggcacacttgactgatattaggaattaaaaacaacccactggaaccatgggaacacctttccatgtgcttttgcatttcaaggccatctgtacgtgcgtgaatcttgacaccacatatcaaacaaattttataatcaagtctgttgacagtatttctaattttttgatcattctcttcacgcaaagtaatgtttttattattagtcacataagtattcaaatgagttgctaaatcggttaatttgatgatactgcagtactcatgtggagcattaaccaaggagctttcaggggagagaggagaatgcgaattcatcaacaagtcataaaaatcagtctggagcaaaaatcttatcaaaagatggaaatgtttttctttgctttcggaagtaaggctaccactcagcacatctttttcattaaaatctaaatcatccccccctgtcataaattgctttaaggccttcagcaagataattgatctccttagcgtaggtagcaattcagaaattaagaaggtatagaacaaatccaaggtgtgcttttcaacttgatcaccaaatccagctcctaatatcgttgttttcaatacaattgaaaattcagaggagtcaaggcaagtctgggctcgaagctcggattcatatttcctatagaaagacccaaagtcttttgtcagacccttcaaacgctccacgagtacttcctgtaaacaatccttaaaggaaagtctagaccttaataccgtttcaacaactcggaaaaacggataacttggtaaattgctgctacgaatatcttcatagaatttgagtacattctcttcagtatgcttagttaatcgtgtgtagacagccaaggacttgagaatgttctgcagtgtcttaaatttctgttcttcacctgataagagtgttccaaaaggatctttattaagcctggacaacatctctagcatacagatgttgttagaaaactgaagagagagagttaaaaacctatcctggatccaagtaggatcattgcgatttaaccgtagaccattgttagaatctttgagagatagtattatttttccaacttcgtcgttacattcagagctgtactcagaaaaagttagcaataaagattcatccaagcctccagtcaatttctgttgcaaaagcctatcaccagattgaagtttaactgtatcgacaggtatgactgaattacaatacgtttgacataatgggcagatgaagagatctgtactataccgcttcttatcaatataatgtttgaaacagcgatagtgcacggcatgattacaagatacaagaaccttctgtgtagactcatgcattagttgactagctccgttttcttttttcttgtaaaacaaatctgtgttataagtggcgaggtgttcgttattgtcaaagccatgccatggtttgtatatttccattggcgtagggttggacgatagaaagacaggagagtagttttgataaattgggataacaaaaaaatcatctgacacatcgtcatgacaaagagagcagtgaaattcattgagttctcctgccagatcttctccgtccatatccacatcttcgtcattaccagcactgtactcctcgtgcttgtccatgaattttttctgctgacgggagaatctattcataatctgttgttgacgatttttggctaaccttcttttacgctcctgctctgtctcctcgaaatttacaccttgatttgcttttctgattttgtagtccgcgatgtactttgttccgaaacactctgttagagattctaaaactgccgttgggcgcttcatgatcatgttatctagaaggtaatcagcagttgccacgacattctcagaaaacgatccgctttcagagtcaacaatgctcaataacaaatcacatattggtttgctaatatacgcctctggcaaagaatctttaccattgaccatttcgtcgtctctaaaaatggcatgaattaaatgaagtagctcgtaagtaaacgaaaaactggaatcggagacagccaactttaatagcttgaatatcaacttcgcaaagagatttgttcttgtgaagcttcctagttctcgcgcacatgggtctaattcatctaattcaagtaattggggtttgacaattattttggcccgtttttccttgctatcagctaaatgtgacttaacaatcgtggcactatgttcaaaatcatttcccatattcagtaaccgcagggaatctattctcttgtagagttccttctttagtttgaaaacaccattatcttcgagccctttgggctcaatgtacgtagaaacttcttcgagaactgtatcaaattgggaaacactttcagtaaggtaatcgggtatatcgttcaataagtcagtgtatgatagtggttcagcgtatagtttataaataatggcattcttaatgttgtacaattgtgtttcttccagggtatcgaactttttataaaagtctctttccaccaatatctgatataggaatgcaacgaattgttgaataatcgacgatattttatcatcgtacactgtctctgtcgagggaacacttccatcaaaccagtcaagtaattcccacctatctaacatgttatagatgactctttgaaaatcgtttttttcaattagaaacgccaattgattaagttgtatgtctctgctataggagctcatttcaggattgttcttgtaatatgctgactggtgaagaactgacataccatttctaacccaaaatcctatatcgatttgcgaacataagacgacagatctcaaagcaaaatccgaaataactagatagtctttggattgagataaaacttgaattgacacctgtaagggaacatgctgcacaaggaaagaaaacaaagtatgaacgggattcataaatgaaactcgttctttgctgatttggaattttatgatttcaaagtctttgtataatttgtatgacaagtttctatgtcccaaaaatgaatccaataagttgatggccccaataagcaatcgctggtcaatgtgatcctttgattgctgcaaaactttatcaaaagtctgaatgatgctatagactgatgtcgtatactccaaatatggaataaaatgctggtcttcccttaaaacatgctctccttcctttcttttaatcttccatgcgccgttgaagagtttacatagtgttacaatcatgataaactctcccggtttcaacaatagattagggtcagtgattttactgagtaaagtttctacagcatacaatccttgtttgaatgatatactgtagcttttagaagggttacttctctgaacccgttgccaaaccaacgtgccctcatccatggtagaaaagtcaacaaaaacgtcaatcactgaccatatgacgtagttgaaatgtccactgtgaaaaatactgtaagccgtagttgggcaggtgaataactgaacgacactctcccttaatgatgtaagttgaggttcacgatccatgaaggtcacacttcgtgtcatgtgtgggaaaatttcgactagctgatcagtaaacattggtttgtgcacagcacttgatgctagtgttggtataattagatcctgaactatttttctaagcttcttccagtacctgttttcgaggaacaacacgtattgcaacctagaattagtatattcatgatgatcttctgctattactttattcaagatgggggaaatagcagatatgtctccaggatctagggatttatgtcttccaagagggatcttgacaccttcacccaaaaccgaatgatccgcatacaaatatggatcatcactcaggtaactatctgaaaagtaatctctaacaactgaggtcatatcgatagactgataaaaaggttcgtacttggaacatagaactttgcctatagcatttctgaaaaggctttggaaagtagagtttgggatattcaaacaatcattaatccacattatgctatacttacaggcttcttgatgtagatattcataccattgagttattgtgcagctcaacccgttactttgaacggaaaagaatcctcccattaaagatgcgatatcagcgctgcatctcaacaatgatctcccctcagaatcgatcttcgcagtcaataaatcaatatgtttgttatcaggcccaccttgtctaatggcagcagaagcctgcgaatagttatgaaattcatcgttgtataccaaaatagcataatctttaagtgtactcaagggatctaacgatgtagatggcgtttgttgctgggactcctcttcgtccatgtattgatttctatatgccaatcgcctcagcatgtcagcttgttcattatatttcccgttctggatgaagtatctaagtttcgcaatgagtggtttttgaattgttgttaatggctcaatgttttggttgaagacatcgatgaaatgatcaaataattctattaggacgctttctagcatcttagaaatcttgccatcatggtcgtcaaactcgtcttccaaacgaccattatcttcagcacctttacagttcaattcatggttccatgcctccttgtcaccacaatcacatataccgttattgaattctgtgcagatcgacgtatatacgtgatgaccaacgtgatcctttggattgaaacagtttacacatagcacacaagtatcatcaaatgaacactccttacaacggtagatcggttcgcctactctaaacttcgcaccacatattctgccagcgtggttgaatttcgaatgcccgccattctcatcgatcttataccagggtttcgaactcagcttgatttccattgcttggtcgacattcttggggaattcacgctcatttgtagcagtaaacatatgcggaagaagcctaccactgtctgaaatcatatagtaataatacccatatatgaaactcttgagctctttatccataactgctctctctgcagatccctttatatctttgaattcaggccgagaatgaatgcagcctaaggttcgtccaacatgttgccgcaaaaacgactctgggtcagtatcgttaatcatattaccttagggattgttctgatattgctatgttgatgatcagttgtttatacgacaaatcaacctgtattgaacctttgtcaactgtgcattggcaaggaaagtcaaaactcttttctgatatcgtattccttttttttttattgaatctttcagaagataaaaatgaatcctctcaatgtatgtggaatttgaccgaagcaaagtgtaagaagtaccctagaaataatcatttcggttccataaacacaattgaatcatttaataagcaggttatgtttggtagcaagtggtacactgaccatcaataccttcttcttcaaataggttgtcaaaataatctaaataaagcatttctttcatgtcttcgatttgtaatccaacgttgttctcagcacacaatttagcgaagttatataaataaaaaaaactacgattaagttaggattccagctgcagttcaacgtctcgatccaaagaagctcgcctgtttcaaagtcgtcagccctataaatccctgacttttggttcaaaagtaagtcacgtgactgatattcggtcatgtgaccacggtcaaacatcaaaatatttacaataatagtccctctatacactccatagacactacccaactgatgctaactccattgtgattttacatcaggtatcctaagatattcttttttgtgctcttcgtactaatgtttaaaggtggcaaatgcctcgaatacttgctgaaacgaaaaactgaaagtaagacaagcttaaaaatgtaaatagtaaatagataaatggatgcacgttatatcaaggggcgcgcttcttgtttttgctctgttaatagtgttcattttaggtttgaatgactagcaagccaagaccagaaagaagcaggtattctttttagcgagtccatttaagatgggcgaatcagtgcgatgtctgcgtgattttttggttcactttgctcatttctgcaggtacagatacaatgatatgtgttcgttttacctttggaaggttctactcacctgtatgaaccattgtaatgaggaaataaactgggaagatcttactcatgtttttgggttaaatcagtgggaaatgggcgattttgggaagatcaaattgagatctaactggcgtgagtcactcataccgaaaaggaaacataacgatcatcgaggttcgcagtgttcgaaacagtgccatggcactgagaccgtttactactgctttgattgtacaaaaaatccgttgtatgaaatttgtgaagattgttttgatgagagtcagcacataggccaccgatatacatcacgcgtagtgacgcggccagaggggaaagtatgccattgcggcgacatatctagctataatgatcccaagaaggcttttcaatgtaggatacagagtaacaatgcagatattgatgttacgaacctacaactgtacaacgatatgtggatttcaacgttctcgcaggtactcgattttattattgactgttgttttgcttggatggatggcgatgagaagataaaacatgaagctgtggagtccataccgatcaaagactctgtaggaaatgtagaatcattttcacaaaagtatgttctcgtcttataccagcatgaatgtaacatacatgtgcaagatgttgcaaggaaaatttcaagggcattgaagaaggatatctcgtttggtacgttcgtactctcacagtttgatcaagatgagcatttcaccgttattgccgaatcaaccaataaggcttttatgctacgattgaagcaagaacttgaattacaagatataccgacccatttgatgaatgagtccaacgtttttaaaaggtacatgataagtgaactagtacgatggttacatcattttgccgttcataacccttcagttttatctggaaaattgtctcttagacttgcatacatggatcaatatgtatccaacctattggccgtgaagccattcaaaatcaacattcttgggaatttcatcgtaccacatcaaaagcataactcatttccctggatcaaaccctggaacttccaaagcaacagtgacgaaacacatgatccaaacatcaccaatgtcatgctgatatatgaccagaaaattagagaaacggatacccccaatacagcatgcagatatcttcctttatcaggttctagatttcagtattttatcaccgaatgtctgactaccttttcacagttcacgagaatgaggttgttggaagtgtttggaagtatctttagtgttagagacgattcaaaaaaatgcttagcggctcaatatttggatgtctattgtaacatcctatatcgaacaatagtctctgatgcaagcggctataaactaacactcatgagcactctttctcaatatatcttcccttcaccatcaactgcaaatatgattatcaatgctggcttcatagaaagatgtcttactttcagttattcaataatgtcttcggactcggaaatagtccctaattcaccaccgattccattgagctcagaattcaaactaccagatacggttatcaaaaataaaaaagcagttatatgcttcaaagacatttaccaggcgatgtgcactaacaccaaacctgcatcagtttttgccaatgaatccttaacgaacgcaatgcgcgaatgtttcttttctttcaacaaaatattaccactaaagcgagaaacctcagaacatgtccagtacgaaaactttgatttttcctcattttacttcttcttctcatccatcttaattatggttgacgggtttctaagaaacatatcacttgtattggaccccattaaaagaaaacaattggtgtcaacattgctcactacttcaatcgataaacacctctcctcattggacaaatttcgtccatcaatacccggaaatacttctaacaccttcaaaacaactgtgtgcaacgtacagactcgaatttttaacttcaaagttggatcagaaacccagaattttttcaatccgatatcgtattacattaaattcatacttcagtggagtcaatgtggcagatacgaaccccttccagagacgctcaaagattacttcaatttcaaggaattttttaaatctccaactgaatgtctttggatagcagaacaggccctctgcactttagttatgatatcacagattgatgttgggttttgggtacgcaatggctctccaattcagcatcaattgaaaatgtatacaaaatacagcatgcgtgaattcacttactttagtgattttttcctcgttcagttttcaatgtgttatgcggatccacatgatttcatggttaattttctaacgcgatggggactcaaatactgggcagaaggaattccaataggtgactacccagaagagagtttgacaatcgccatgacagaacaatgtttccttactttaatacgtttaatgacagaaactagagctctatgtgcttcgacttcagttgaaggtttcgaaagtactatgaaatcagaaattatccactctctctgttttcgaaagtgcagttatagttcattagttgaggcaatccctgaacacgttactaagcatcctgcatttgacttgtatttaaaccagtacagtgattaccatgagccgaccggtaatttcgataccggtacttacagtttgaaaaaacagtacaggaaacagattgacccgttcttcgtcgggttctcctccaataagcgctacgaagccaccttattagtccgtgaaaggatgaaagaaacttacggggtttcttttaatgacacatttgtacaagcttcatcaattcaggaccaattaaggaatacacaatatcaaaacctttaccaaatcacttctacagacatttttggcgtgttcgtgaagaacacattggttcatattatgaaaatgaagctcgaatctttactaggcaaagttcttcacttgattcatctttgtgttgtcaataacctggcagactttgaacgaatattttggcatgagtatcatcttgacgagtctgagaatgggttttatcatagtatcggatctttactctacaattttctatcttcggatgactttaacgtagagaatggtaagatcagagagatattccgatttttgaaagatcgggcaccacacattaatgtggacgattacctctcagaacagactccaaattatgaccccagaattttgttcactgatataagtgaatcggaaaacgaggagtacattaagaagaagatgttagcaaagtcgagaagagaaaaacttatgcagaagctagccaaacaacaaaaggaattcatggataacaacaatgtttctgcagaggatattagctcacaaggaaccaatctcgataactctgctatcggtatatgttggacatatccggaagatgattgtgtattttgcaagatgcccaaagattatgatgttttatcatactttgtatttgtcgaacgcaatgttgtttctatcaatttagcttcggatgacaaaacaaaggatgtagaatttcaaccggtgcttacaacttgtggccactgtgctcatttcggttgcttactatcacatatgaaatctttgagaaaaagtctagggcaaattaccaaaaatataagagatacatttggtttatcctcgttaaattgctctttgtgcaattctttggtaaatgcattcatacctcttttaaaaggaacgcagtactgcgctgattataattctaaaagtcttgtcacccgccatagtttggctttgattacggagctcagtggcttgaagttctcattacagaatggcttcacggctggttatactttgtttgcgaacacgatttctaaccttgagttggtattacgggatgaaagcaataagtttgtcataaacaagttaactagcagacaaatcaccagcttaaggcttttggacgatttgattagttttggcttagaaaagaaaatgatttccgccagcggtccccactccgatgacatatttatgtcactttgttcctcgatgcacatgctttccgacgacgaacatatactgcatcttttgaaaacgaaattaatagaggaattaagtctgaggatcaatgaagttgctgctttatcttaccaaaatgacattccacgtcaaaaaaaatctttctcaattccttacagagatgttatatctcaaattattatcagtaggattcatactactagtgtcattaatcagaccgaaattttgaaagcagaaggtatctttcgtggaaatgaaatgatatttatcgattttattatggtacagtttctcatctttctaagaaaggtgtgcattgccctccattctaagtacatcagtgcagacaaagctgtcatttctggaaaaggttacaatgaacttgaaaccatgatagacttttgcaacctacctcccttcatagaactactccaggaactgttttgcaagaatagtagtgatcccgaaggttcagggaaatgtagcattgtcacacgaaagccaaagattcccgtttcttctccgtttattgatttaccaagagtgatatcatatatgtcaaagcagacagattccgaaataaacctcagattcagtgccttcaaggaagacattgccatttgtatgttttgcggattatcttgcattttacagaaagtatctttgttacatttttcccgaattggacaatgcacaaatcattattacaacgagtgtaaatgtaaagcgccatttggatgtttcttcattcttaaaagtaacatcatttatttaagttatggtagtaggggatcattctatcaaacgccatacgtcaataaacacggtgaaactgacgaagattataaattgggcactcctgtcttctttaataaagcaagataccagcatttcattcaggatatcatgctctctggaaaaatacctcatctaatcaatcgagctaatgacaaaactgttgatgttggtggttgggaatcgatgtgacgcaaaaacggacgtcggcataaggcagaaccatgctcttttgctaagctgtgccattattcactcgcttgaaggaaatacaaacaatagcatctcatgataacatagcagtacatacatcacaacatatcatcgaaaatacatcataggcctttcttttttttttggcatttcaaccttcgcgacgtctttgcccagaattcttaccaaggcacattaaagcgcttgtctttaatgatgaacaaatcactgattgtcgaatcttggtacttgatcctttacagcattcaaaatatttagaggactattttataaaattattatattatttagtgcgtgaaaggttatttggcatcttccaaattagtttcttttagcgcttcagccgcttgctcaacagctggcttagcacctgggtaacgatcacctttattctttgatttcttagctttcttggtcttttcaactactggtggtggataacccttagcttcagcctcttggaactcaggattgttttgaaattcttctctaagtggagccaatagctcgttgatagcatcagagacaccggactttaaatctggaggagctaatttttgctccttgaagtcctgcttaatctgatctagagaagtatatgaaattggtccaccgaatttttcaggacggttgatatcgaacttaaagtgatcactaccgtatttcaactcttgtattggtgcaacaacagattcgatgaaagccaataacccattatcttcaacgacacctggggcacagaatgcactgttaatcttcttcttaacttgttttggttcttctaataaatcaatcttagaatttggatcagaagcagacatcttaccaccttggcctaagcctggaaccattggattcatcaaatgtgctcttttcttatagcccaatttttccaaattctcttctgctagcacgaagatctttctttgatcaacaccaccgaattggacatcgacaccaagatgttcttcatctaaggcttgcatcaaagggtaaatcaaaccactcaacaatgggttagcgacttgcttcacaacatcggcaccagctctcttggcatcgttttgagaaacaatgttagacaacttgaagatgtccatgatgtattcgttggaggtttgataagaagaaccaataacgaacttcaatttttcaattggaacgttgatgcttctcaaaatcgccttgatgactagttcgtaatactttgctctgtaagcaacaacttccaaagaagccttcatattatccaagaaagcgtgcaaatcggccaatagaacagtaacttcacagccagctttcaaaaaatctgccaacttggtcattggaacaaaataaccacagtgaggtctaccggttggtgcagtaccccagtacaatttcaaaggtctcttttcaacttccaaaacattcttgataatctgggcattgagaacttcctgcaagttcttggtgatcaaagcatattgttcatttggatctgtgacggacgacatctcttcacaattcgtatcaacttggattataattcctatctaaaaagccttgtaacacaaaaaatggcaaaacagaaaagacaaaaaacacttcaggatagttctcaaaaccctatggttgagcttgataaatattaatgctggtgattcaaagtcaactgaatacaaacaatccttctggtcaatgtcaagtgagtcacatggaatctgtcttcttttgtcgaaaagatacagagagatgagaacaaaacgctgaaaatgatttttagatctgatacacccgtacatcacataccgtacaaagcacgtgatcaggaaatataattccaggctcttaatttagtcaaaagctgactccaacaacgtcttaatatagcattcttggtttagtagagtaatatacatccacttgaaggtctcaggttacttacaacctgccagaagcccaccaacgggtagttgattcttcttttttcttcctggttgctagtatttttcaatgaagaactggagtttgaggaaactaaaagttttgaatatcaaactatgaatttacaaagtatgaagaagcagttagcaattagattgcagttctcttgattgaacaggatcaagcagctggtattgtaactctgttgaatagttaggattttggtggaagagagcagtggaattcctgctacgaaaataatcgagcctactgaaactatgtctaatgcaaccaagtccaatgatgcgtcgcccttcatcaagagggatcagatgagaagggagttcttgagagcaagacaaaggagtaacaatccgaagcctatagtaaagaaagaggatcccgaacaagctgcagaagaggctaggaagttattgcagcctgaggcactatctagaagggttaagagggagccaggtaagtcagggtatagtgagtttccattgcgagcaattgacatgagagataaagaaaacgttaagacgaatttggtcaaatttcagtctaagaaaccaatagaccctgaggatttccatttacccatcagattacatcgtaaggatactagaaacttgcaattccagttgaccagagcggaaattgtgcaaagacagaaggaaattgcggaattcaagcagagacaactcgaagaagcaggaggtgcaggaccgggtactggcggtagcaactcaacgccgacagcatctaaaggtaacagtactggtggaagtttctctcaatctaacgggaaaccatataatagcaaacaaggaacgccagttccaggtacgttgaatggtccaaaagtgggagtaactaattataataatacagatggtcctaacgtgaataataacggttcatcaagttcagagctgaaaactggcacagattccggctctcctccaaatgggaaagaaggaactcccagcaataccgtcactatccttgaagaggctggagtggcagaagacccaactaaggtcggtatggttaaatatgatggtaaggctgaacctgagatacacgaagaaggtactatagaccctatggctgatgttgcaccacatggaggtggtcgttttagaaggggtaattctaaaagaaagacaagacagttgaagagattagatgaagaagcgaaaaggttaagattcgaagaattttatccatgggtcatggaagattttgatggttttaacacctgggtaggttcatacgaagcaggtaactcagactcatatgtccttttaagtgttgaagacgacgggagctttactatgattcctgcggataaagtctaccgtttcactgcaagaaataaatataacacattgaccattgaagaagccgagaaaaggatggagaagaacaaagaaggtgctcctcgttggtttatgaagcatttggacgagtccagtaaaacaaccacaagatatgatagaaccttaagaagacttagagctgtcgatgggaacacaagacaggccgaagatgatgaggaccgtggagataactcagaggtcgaattggattacgatgaagaatttgcggatgatgaagaagcaccaatcatagacggtaatgaagaagagaataaggaatcggaacaaaggatcaagaaagaaatgttacaagctaatgctttgggattacgtgacgatgatggggaagagtcagatgacgaactatttggagagaaaaaaattgacgaagaaggtgaaaaagtcaagaaagccctccttaaaacagatctgggtgctttatatgaatctgatgcagaagagaacccatatctatcacactctgaggaagatgaagagcaagctgattcggataagaaagattccgagaaggataatgaaaagcaaagtcggagatcctcaccaaagaagaaagcttctgacacaccatcaggtccaccaaaattagtagtaaaaagcattaatcaaaatatcgttgtactaactggtgagaaatcagtattatcgaacttccctgcaggagcctggaatccaaacttgaagaaacgtccagcagagtctcagccacaagaatctatggacaataagagggcaaagtctgatcactcggcagatgatttgttaacggaagacgatataatcaatgcaattgagggcaagcagttgactttgaaacaattaatcagacaattgaaagaaaaggtcggtagacatcctgacaataaagaaagaatgaaggtttttgtcaagaaacttgttaaactgaacggtaaattcctcgaattgagtaagtagttaacataatttcctcgttttcaaacctctggagatatacatgtagtgataattgatatatatcacctgggtccaattggaaggggcaggaaatagcatattgatatagtcagtttattaacaataagtacgcttaaaataaatatatgttatttgaaaacaagatatctataggaagttatcatttataaaacttcgacgatagcatcgtcatcatcgtcggactcttcttcttcttcttcttcttctatctcggctatttcgccatcttccgcagatttggccacgatttcttctatcacttgattctccggctcacctctcatcaacatgttaacaattctatgagataattcaccgatatcgtcatttccaatatttttatgtaactctctgaccaatgggtatactgatttcgatcttaagtattctctgccggctttagtggtacaaagcaataaaatactttctaaatgcacacatatgatttcaggaataggatctctctctttgtcggcaggtaagagttgcaattcatccggtagattgaacatatcttcttcatcaatttcggagtctttagctgatgcaatcggtagaagaatataaggtaaaagattgatttcctcattagtcaaaaggttttcatgcttttcggaatcaaataacgaattcttgatggtataagccacaccttctcttctggttttagcatcatacttttcagtgaataccaatagtttagaaattgggatgacgccgtcatactcctgctgttcaatgaaatactctctaccaatcttaaatctcgaaatgtcggcaaagaaataagctaagtagtcataagtggcatatctgttcaactttctatcgtaacccttcacaaaacaatccattaagcaatccattactttgttgcttttaaagacttctatgtttaatggaataccatcgtcttccttcttaacaaacgaaaacaattcggtaatattgtcttccttggcgagattagacaataaaatacacatgatatccgcacttgcgttagctaaatcacagattttccacgataagtactgtaggaattcagtatccttgacgatcaactttctcatagtaacatcatcacataaattcgctaaaatcgtagtggattgttgaacgataacttttgacttatctttagctagaacttttagatcctctatagctttgtaattattacatttgaaaatgacagcacttgctccagttgagaagccaaccagattatcaagagcaatctgtctgacggcaggctggtctgaatgcaaaaatgacactaattcttctaattccgtggacatcttccctctttatcgtatcaagtaaacgcagatatttcgaacaaagatgttttattgaacaatgaaagttatagttgattagctggtgaacaatacctagttacaccaactgccaacgtagatatggttgatgcgatgagctgcgatgagtttgtcaaacgtttctcaagtttcgtgaaagaaaaggttcgactctttaaggcgggtaacaattacatcagcatcaaaccgacaataacagatctccatcttcaattaaatgaatagaaccaccgttagaaacagagcttttcaatctgcgattcgattgatccttaagtgctgcatttatcataataaatcacttttattctagtcttggcttattgcaaccaattgcaatcataactacgagataacagcattggaaaatgagttatcgcttcaccgacctaaagtcttccaaaagtggaagtttcaacaacaacaaactactacggatacaggattctacaatgctgacagcaggacttagtgctgggatattgcaacttcaatcttttgcaggttttggaatgttttttgctgtttatatcctggtgaacctcatatttatagcgtggttttgcaaattcaagcctagtctatattttactaatccagtgcataaaatatgggttaaaaatctattccgcgagctagctgggtttgtcatgacttggacgttagcgttcactttggtcaggtaacgcatatgacacattttgcattaacgggttgatttcatctgaacgatatcaccattaggattctagaagtactataatattatggtcattaaaacttatagcagagataaatatttgcatgtattataaacaggatgatgataaacaatatgtacatttaaaggatattaatttattaggtagtaatctgttctcaacaacagattttagaagatattaagatcttcgtgagagatatcacggggatacaaaacgtaagaaatggcaatcttcatcaatagaatgatttagaaagtgaaccagttattagggaaagaaagcgtggttatcaaatgcaaatattcgaggcagaacaattttttttgtcttgctttcccaagttgaggctgacatacatctatatctgaattttttccaccaaagttgctaacttttcaacactagccaaatgcctgttacccaaagtgttatttttattggatttatccaaataggatctgatggaaataacaatcaacctctcatcttcaccagttgcgacacccacgagcttttgaacaacgtagttcgcgtattgatcccgcatcattagaatcaatggtgcattatcttccaaatcagcggcgtgctcttcgtctcttggtagaatttgatccaaaatctgtcttatctggtttttggatccgtaaactactgacttttcaacaacattggaggcaaatttgtgttttgaatattcaacaacattcttacgaatgatatcgatgatattttgtttactcattcctatgtgactgctcgtatcttcagttccatgctgtaaaatatgctgaattacgtagttaccgtattgatcctggatcaagaatgggatgaattcatccaagtcattcaaaatatcatcttggtcctttagagttccaaattccaatagtctttgaactacacggcaaccgtaagaatgcgttgataaatgatagatttgtcctcttaaactttggagaataaatggtaatttttcaatcggaatacactcgatggctttttgtataacatggttaccattctggtctttgatcatagctaaaacacaatgggaaagttcagatacgagatcaaccttttgatcttcatttaggaattcaaatgccttttgtataacacggcaagcatacatttctaacgacaagttctccattttgcctctgaattgatccactaatacctccctttgtgtttttgtaccatgttcaaagaatttttgaatgacatagttaccgaacacgtcatgagataatggtatacattggtctctaatctcattgaagattacttccttatcagcatcagaagctgttgccaattcctgttggataaatctggaaccatgttgatctttacagaactctaaagcggagccgtaaatatcgctaagtttgtaaactttattggaagaattgttcctgaattcctccaataatggggatctaacgataggctgtttgttattctggcgagcatttttaccttggcgaccctgtttgtttgcacctgaacctgaagaactttgcaaagtgtttgggggcactgccatacctgccctacttggtggcggagagaattgtgaatattgagccttacctgcgtgcaggtatggatttgatttatttttgccagagtatttagaatcgttatttctcttgttagaaccggaaccattgtctgcggatggaggggagcttggagcgtcttgtaagttacctggacgtggttgcatagatggaggcatgaacatgtaaggatttggtggcaagaaagtagggctcaaaggaggtttaacagtttcactatccttattattttctgtgtcatcttctttgattggagcatacatgaaaggatatggactggggaatggataaggagccattggatgtggcatcatcgttggatgattacctgtttcacctgatgtctctgataattcggactcgtgttggttctttctagaagcggaagcctctttggtaacaccatcagtagtctcgacatcttgactgttatcgttggatccattcatacctgggaatggttgtggtggtggagacagcacaggaggtaaaaacatgggcattccaaattgattaaacccaggataaccatagttgaaaggagctgcctgctgattagcaaacgaggcagggtcatttggatcaatgtcctggtcacttggaaaaggagcagttttgccgtccttagaacgacggtaagagaattgaggctggaattgaggctgacgttgatgcagtggagattgctgctgctgctgttgttgttggtagtggtattgttgttgcatgtgttcggcattctgaggtctgaatacgggtgcagcagccacgttccaaatggtagtagaattaggctcattattttgcatcgataaactttcactaacggagtccaacacttcagaggtatccgacattcttcttgcaccatgcagcgtcgtattagatccgactctcgataaatgctccaagcctgtggttgcagatgctcttctcgagccagtaccagcgtgattcgaactcgaaggaggcccaccaacgttaacactacccacacccacattcaattccacttcacgagtaccctcagctaaggcacgaccaaacctttcgaaaaatccagatgtaactgaactattattgacaccgatcgaattagaattagtcacgcttccgttgtaactgttcaagttcggattattattattttggaattgagctgtcagaccaccagcgatactggcagagtaatggttcatggcattcaatctattctgagcgtgggacgaagagttctcaggcagagacatcccgcctacagacagagtagttctcctcaacatgggagaattctgtgtattgaaaaagatctctgagtccacatcgcttcccgtattactattgaaagaggcccttctgaacccaccaatctgttgctgctgctgcgcctgtacttgctgctgttgaacctgctgctgtgcttgttgctgtacattcggatttgacagtgccgaaagcgacgagactattgatgctaattcagaatcaatctgggtattattatccttatcgtcagaaacagcggtattccagccgttcagttgctctgaaagtgacatcttaacaagatttgagtactctaaaccactgacaactaacttgggaaccgcaaataccaatataaagtaaaaatgcgaagatcaacgacaatgtagtattaacaaaaattgaggaacgacaaagggaactctggtcccaagaaacaaaacaaagaaaaatgggggaaaaaaaaagtgatacactaaatgcagttcacccaagcctaaggtacctggagagtaaagctgtaacaaaggacaaactcagaaaagactatatatgccgcgaactggagtgtcctttactccagagtactttaatatccaatggatagtttcaatatccataaaaacgtaaattaaacaaaatatgaaaagttcaaaatgttgataatcgataattccaggttttctcatgaaaagacaatgaaagccagaagacgaatccctcgacggttatgttccgttcttgcagggcatagttcgacaggggaaccagttcggaaaaaccagaaaaattaaatcatgtccgggtagtagtttttaaaaggtcgcccgttcgagtcccctatgttctcgaattttagtaaaaaaaaagtataaatttataggagtttcatgataggcattatttcgagaacccggtctagattgagaccaaaagaaatgaaactaaaaggaaggtaaagggaaacgaaaagaaagaggaataacatgtcagttcttctccatgtattctaggtcattagttaagcctttttttatttcctttttatggctgagtagactgaactggactggaccggctacaaaatgggaacgcggaggagggtaacatggcagtgcgtgtcccacgcacttgcaaactcacccaaactgatccctgagtccatccatactatctgtccctccacatttttgtttcggaaaagatcggccagagatcttgtttcttgtcctaggagaataagaagaaaaaagaccaatattctggcctggctagaatatgatgggtgtacgacacgttcttattgttacgagtagcgtattatgaattaagtaataagagaagacggtgaatggaacaaactgaatacatgccgtgttcttgttcgaagaatatccgagtgaaccgtgattgtataatagagacggccggaaacatgtgtagtatctgtgaatgagatttttgaaattttcggttaattcgaaatttgaaatttgatgtgatatcaattccatatgctttatataacaagatgaatttatatattccgcagtatgagctggtttgaaagggaaactactactgcaagacatatcacaagtttcaatactattccataccataccaaacgtcctttttcaagactaggatattcaccgttaaactatacacatttccgtctactgaatccagatcctttttcttttttttccattttagtttgagctaaattatacttcgtctttgggtatatattacaagagacaagaacaccatcacattcctttctatttgtattagttaactccttcaccctgttattgccaggctcagtttcgctctttttttcattcaggtagctccgatacatcatgtcaaagtctgaagattttattatggaatatacctcggaaaatgtcactggagttgacaacgagttcagtctcagttccgaagatgaatacgtcgcgctaacaagacttgcacggttcatcaaatcagcaaatcagaaactagagaaattggagtccgtgcttccttcaacttctgtcgctacgacgacaagtttgcccagacaagggtttaacaagttaagacaaagaggccgtaaatttttgagatggaacaacaagcctgtcgaggctgagaaagaggtttcatatcaagatttcatcaacaatccagacgcaccagcgttttataggtttttgaaacgtaccacggaagagttaacagctgttttgcctgagaatgacactgaaactatgattgctgaagagttcgaaagaagtttgaacaggtcttcaatcacttctccgttgttaaaattctcacagatttacgatgatcatttcacttcgtttgcttctagctctacgactcttcactcctcgacaaaggattctaccagatcatcatcacaaacttcatcgaaaatgcctcggtttgacgatagcataagtcatagtgctctttcgtcttcacactctaacagttcagatgataactgtcaagacaactctcgctacgattcacataacgtctcctcgttctcaatcaacaaattaaagctggaccgtagtgaaatgtgtgaactggaaactatcgacgataaatgcgtcgacattgatacccaacaagtgatccaaacgctagatttcctcgacgaacatctcgacttgttcattgaagatcctcactcaattaagaaaacaatacagttctataactgggataacgcatgcgatctaggtcgccaaaggcatttgcatttctacgaattaccattcccatggagagaaaacaggtacatcatccacggttaccgattttatgattctcatgtaaaatctgtattatcggtcgtcaactggtatggctggcataatgaaacactaaacatttggtcccatttgttcggtgcagtttatttagcataccttttgttcatccagttaccaaccactaaagtattcatgtcccaagatgtacctttatttggtaaactcataatccaagtttttttgattgcaggtgtaaagtgtttactatcatcctctgtatggcatacgcttaatgggacttgctgtctaccactgagatgtaaattcgcatgtattgattacactggcatcacggtgttgatcacggcttccattctatcgacagagtttgtgtcagtttataaccttgctacccaatcattatccacctcaatgacggtatatatgtcactgtcgctttgcttaggtattttcggctccttcatgaactggtcccccagattcgatagacctgaatccaggccgttcaggattgccttctatgttctattagctggtctaggtatgatctcgtttctccatctcacgattagtcgtggtattgaccactcatctcaatttttcaagcctgtttggaacaggtcgcttatctggtacctaatcggagtggtattctacggttctttcattcctgaacgttggagaaccgatgtcgaattagactataccattccaacagacgcagaactatgctcgaatttggatattctgacgaaacacaaacacgtccacttcagagcggtcccatcgaaaagctccagaaccgggtttttctctttatggtgggtcgactatttcttatcatcacatactttgtggcacttcttcgtccttttgggtgtgattggacattataatgcattgctcgacatgttcgaaaccaaatggcaattatgactttaactctttcacttcaaacttctttcacaaactttacactccgttaagaaaacaaagactttttatcttcatttcaatcttattgcacacctaggaataccatcttggtccttctcatttattactttctgtacatacgaatttagaaatccattcttggaaatggatttcacgaaacatatttttaatgcccttcgatactgaaccattctttgatatatatatatatatgattgtgttattattattggaatatttcattgtttacgttacattatagtatacagtgggatcaattcgaaacttagaacctaactctttgttatctctttcccaaattttcacatttaggattaaatgtcacacttacgattcaaattcagaatgaacttcagttggcgttatcaactgattctgaacacagtgaaatatccagtaatcacagaaaacaagtaaacgcatgtatggtttaaaacatgactcgttggctaatattcaacccatcttcattccatgccttcatctttcttctctctgattatttattgaacctttttaacagatgctataaaagaaaaatatgtcattggtaatctgacctcatctcatatgttaggaagagtgagactaaagaaaggaaagaggtctaccaagggctgcacagattacatttcacagaatggcagtgatcaatcagccttcgggccagatcaaattgactaatgtttctatggttaagctaaagaaagctaagaaaagattcgaagttgcatgttatcagaataaagttcaagattataggaatggtgtagagaaagatttggacgaagtgcttcagatcaatcaagtgtttatcaacgtatccaagggccaagttgcttcgaaggaagacttacaaaaggcatttcaaactacggatgtcgatgcgatcattaaagagattttgtttaagggagaaatccaactctctgagaaggaaagacaattgcaattgaacaaaatcaacaatgaaatgctaactattatcagcgctaagtgcatcaatccaaagtctaaaaagagatatcccccaacaatgattcacaaggctttgttggaactaaaattcaatgttgtcgttaacaaggcagccaagctacaagctctagaagccatcaaattgttgattgctaaacagattattccaatcgcaagatccaagatgaagatcaaggtagctgtgaacttggagactgcaggatcatcagaactcattgaacaattaaatactctaataagatctggccaaacaagtcaaacagaaacagcctggacaagtatagggttaatagatccagtggcatacagggaacttgttaacatctgtaatcaaaaggcaacattacaagtgttagatatggctgtgatagaagagtctaattaaagatacattatagtatatgtagctcactagtttacacattattgaggcatttcccgtattcttttgcacttaagttcaattcacatatgcttctttcacagcatttaatagaaatatcaacttctcaaattcatttgattgagacttcctccataactttgtacttagagtgataacaaagtctggcacactggctcctacttctgacccaagagttggtaggatgactcgttcatataactgggctatttgtgtgcaaatgattggaattttcatgtcattagagtcacctaatttcgttatgacatcgtaatgggaaagcggatcatttacaggagcatagtcactatcgtcatcaccaccatcaagcacaaatcgggcctctgtgtcattcaaacctttagatttcacttcgtatgtagaatccatctcaccatttactcgaagttgtagcactatcttattgtcataatgattggcaaatatgcctaattcaccgggaaaatcactaaagacttccggatctaactgtttttgaaattcaatgaatctcatgttgcaccttgaatgaattcaaattatcacttgctttattactgtggtatcttttgtttacatatttggtcgtttatttagcagtatttctttccttagcatattacgaacatcaccttgatatttttgtgtaaatgcaaacattttgaacaaacgaacagatacatgatctaaagcagaagcaaacaaacctaattaattttatagcttctgaattagtggcacagtagttagcatctgagtggtttgctatggttcaaaaatggtaccatgcagtcgtttcgcgactaataacggtatgcttccttactgtcctaatgatctgtgcaatatggcacaatttctttacgtcccatctgctcaagcgcaaacagcgtatcatattagatccgcgtgataccagggccgctaatgtgatcacacctcaaacaactggccattcacatatggtgcgcagaaggaccgagtcgttcagctccctagttccactggaagtcgatgtggaagtcgatgatgtaaacaatatcgagtatgatcgtaccatatcaagaagaacggaacttaaagactctgatttcaatccattttccgatatcttgtctgctgaagatttgaagctagttccaaatctccagtattactattcccaatacaatattatcatcgatgaatatgaagtaacaacaaaggatggcttcattttagagctttggcatttgagaaacgagaacgaggggaagacaaacacgaagtaccctgttttaatgttacatggacttttacaaagtagtggttcttttgcgtctagtggcaggaagtcattagcttattacatgcacgattcgggctacgatgtgtggttaggaaataatcgttgtggattcaactctaaatgggatagagaaaagctgacccccaacggtgaatgggattgggatctagattctatgaccagatatgaccttgaagcccttattgaaagtgtcctccaaaaaaagcaaaataagtttgagaagcttaccttagtggcccattcccagggtaccacacaagcttttatgggacttgtaaatggtgaagagatctacaaaaatacagagttcagattgagtgataaattagataatttagttgcattagcacctgctgtttatcccggtccactactcgatgaaaaatatttcgttaagtttatggcgaaacacatagataatcgctgggtattcggaaacaaatcatttgtaccaatgatgatggagatgagaaatttgttggccggacacaagatattctcatttttgtcttacgtcatgttcaactacttgttcaactggaacgatattttatgggacagacccttgcgtgatagacatttcctattttctccagtgcatatatctgtgaaattgatgcaatggtggttaagtcttaaccctttaaagtcaagcttcaagactttcgccgaagacatgttccccgacatcaagacctggttcccaatacaaaatgaaacagtaagtatggatgaacatttacacagaaatcaacataaacctttgccagaaaattggccaaagattttactcttcacacccaggcaagatagacttgtagacggagaaagattgattaatcactttatcaaccacgaaccacactctgtctacaaaatctggtatattgatgagtattcacatttggatgttctatgggccagtgacgttatcgaaagaattggtaacccaatgcttgcacatttgagaattccgaaaccgacatttgccagttaattaatacagataactttgaatcacagactagaatggaattttgacactttgtttccattttgtgcaacccaacatatagatatacagttctgcaatcattacattttttgtaagatatataatatactaatgacactacttaaacggtaaaaaaagggtacacaaagataatcccaatacagctttggaaactcaagtactcagtgactgtagcaatggctaaatcatgttgttgttattttaataaggtctttaactgtcatcttatatcgtccttgtatattcggcataatttctttttaacaatttttcaagttatcgaaatgcaaatctcatctcatctcatcgcatcataagcagtgaaagggaatgggaagaggaaaccactggaactgtttccatatcatagttgctgattaactagcacaaggtctaccatatttagtgccaactggggatattgaaagaatagcgaaatgaagatcaaaactatcagcagaagtgccgatgattatgtgccggtgaagagcacacaagagtctcagatgcctcgtaatttaaatccggctctgcatccattcgaaagagctagagaatatacaaaggctttgaatgccaccaagcttgaaagaatgtttgctaagccatttgtcggtcagcttggatacggtcacagggatggtgtgtacaccattgcaaagaattacaatgtattaaacaaacttgctacggctagtggtgacggtgttatcaagtactggaacatgtcaactagagaagagttaagttcattcaaggcacattacggtatggttactggtctgtgtgttactccttcatatttatctccacaaagagaaaacttcatgctttcttgtggtgacgataagacggtgaagctatggtcagtgaattctgacgacttttccaacgttaaagatgatacaagattgaatacagatgaaggtatcatcaaaacattccatggtgaacatgctttccaatctttggatcatcatagacaaaaatcgaattttgttactggtggtgcccaaatcgaactttgggatacaaacagatcaaagccaatatcaaatctttcatggggtgcggacaatatcaatcatgttagatttaatcaaaatgaggtcgacattttagcaagtacgggtagtgataactctgtggttctttatgacctaagaacaaactctccaacacaaaaaattgttcaaaccatgaggacaaactctatctgttggaacccagtggaagccttcaacttcgtaattgccaatgaagatcataatgcttattactatgatatgagaaatatgtccaaagctttgcatgtgtttaaagatcatgttagtgctgttatggatgttgatttttcccctactggtgacgaagttgtaacaggctcctatgataagacaatcagaatttaccaagttaaacatggtcattcgagagaaatatatcatacaaagagaatgcagcatattttccaagtgaaatataccatggacagtaagtatatagtaagtggttcagatgatggtaacgttagactatggagagccaaggcatgggagagatctaatgcgaagagtacacgtgaaaagaataagttggaatacgatgaaaaacttaaagaaagattcaagcacatgccagaggtcagaagaattagcaggcacagacacgtccctaaggttgttaagaaagctcaagagattaagaagattgaaattgattctttgaagagaagggaaagaaacgaaagaaagacaaggaaagacatgccatttttacctgaaaggaagaaacaaatcgtcggtactgtctttcaatacgaggacgacaagaaatctaattcgaatagatccaacgattccgaagatgaataaaatatatgaatttctatcagttttgaattagatatttataaatttgtaacgttaataagctcgaaacatgtctcttttttcttgaagttataaatcaaggtagttgatcaagttttcctttcaatgaaaaatcgtttttagcaaggaactatcttttaccgagattagcagatatcttctttataatttgaatcatgggttgcatgtaacgaattgaatcctttcatattcttttacagtattagattagaagtatagttccataataaaagtgagagaaaaagaaaaaaaaaaaaaagaggaagtgaacacaagaagaaccagccttgcttgcccaatataatatgatgagtattatagtactaatgagtctatcaatttgaaactatggcaatgaatattagagagagggagagagagagagaagaagatgtggtcatgcaaaaaaaaaaaagacccaatatatgcaatcgtttgcataaacaaagcataaaatgaatcagtaccaactaattatattgtcacatctaagatttccccaacatcaggtaccctctcttcagccaagtcttccagaagtggaatgatgtcaagcaattcattatcgtgggcatctgaaaaccaggatgagattggaatggcgtgctgaggatggaatatgtaagaagcaggggaattatccaagataatcatatctgatagtggtctaccaatttgggaaagattcttgatataattgccctcgtagttgtaacaggagtctctgaacaacctatgatgaatagttttgtccttgtccaatatatccaacaatgggtcaccgtagcgggacacacttgcagtaaacaccacgacttcgtatagttcagtaatgcgtctcaaaaattcgtcgacaccaggcctttttatcacgtacacattgtgaacttggttatcgatttccacaggaataacaaaatcagcagtacgtagatatttgaaagaggaatggaccaacgtttcatccaggtctaagactagacatttcttacccttaaacatatcggccttcggcaacaacaaggtattgcaccccggtgcatgggcctgatctggctgcaattgagacaaatccaaaggttccccatcttcgggctccccatttgtcatttctacatcgctaacgccttgactatgaatgccctcggagtcatccgcactactggtatgttcagtctcgtgaatcgtggtcgtgacctctgcagttggctgagttgcagacactgcggtgtctgcagttgtgccagtacttgtatcagattcagcgttatataccaacagtgtttgcttttcatccccttttacatccacatcgtcatcttcctctccaaccatgtcaacgtcaacgacatcactatcagtatcgttattactaacagcagccgtattcttcgacagcggactcttctcaacaggcgcacttgcaacagccgctacagttgagctatgcttgttcgccgcatttttctttttcagatgcatcttggctgtagaattggataacgtagtatgaatttctgattgtcttgaatgagtcgcagcaacccctggacgtccactcttctttgcacttagcgtattcttgctcttacttttctccgagcttgacccactagaacctttattactattgttacttgacgatgaattcctacccttctgtttcctagagctatccgaatcgcttgaaccacacaataaagatgcaatgaatcccatcacttttattcctaacaaaatcaacagcgacctataaataaatcgagacactgagcgagtgagagaaaccaaaaatcacacactgagcccaaaaaaaatggataaccgatattaatcagattggtttttcaaacggattgatactgttattaatatatgttctttctttctatctaagcaaagaaagatagcaaacaaaaaaaacctaaatacacaaaccaatcaggctccctgaaaccactggccccttgatatagtacccgtacactgacaaatcccggtacttttcaagactttactgcccttctgtaaatggcctccaaaaaaaattaagttgcagttaaaataagagagttagtcaatgaccaatgttctattctcaaaattgtttaatctgcaaaagttgactgtttctggtttttccatgctgaacagaacatcaaaacttaaagaacgaaccaaacgaagcaaaaagaattttttcttttccctggcacaagatggtgcgggtaacgagatgtttttcacttgaaagagatagaggccggcttgaagattcacttcttagtttaactactaaaaacacagctagttcttcaatgttaataaataagaatcgttcagtttttacctggatacggtaagtttcatatcctgatattagtggtgtttttactgtggtaattgatcgagagtttaccccgtaaatacagggatcaagatatataaaggaaaaaggtgagagtagcaatggataatggaatttctgcgcctggcacaccggccaagacttttcagactcccaataggcctttgagccagcagcaatttcaatccttaagggaaaaagctatcaaacagtcgcctgcattgtataaacacaaggtattgagtgatcctaccagcaagactgatgtttccaagtcagattcttcctctgtgtttgctgcatctgcgttctctggcagatttgacgcgaaaccttcagcatcaactaatacacataccgcatcccctgtttttcgaggaaaaagtaaccaggcatattctacacagcaagataccgcaccagtgacaaattctgatctgctaccggacgaaccggtgggacagaaacaacaaacggatttgaacttttccgaagattccgcatatgataaattgactgatttcgaaaacccggcgttggctgctttcacatctcgtatggttaataaagagttggagatgagaaggttgttgactaatgtagtgttggcaatgatttggaatctcatatacaaattcgtgtcattattcttccaattcactaaaaggggatcccaacttcgagacgaactgtatcttttcgtattgaaaaacgttgtttataagattaacccacatgccaacatcaattcattttggttccaaatgctttcttggcaatttgcaaccagtatattccatactattgtcatttttaacattgcatcgtgtctttggaacttgctgataaaagcacaaaatacggacatatcagatttgcatctaaccgagaatcaaaaacgcttgttaggggttgtggaaagcacccccgactatggtagatcctttgatccttcaattaatataggtaactctaaagtgaaatccttaaatgaagcagaatcaaaatccagccacaagcctttcatattcaaatctttacagactccaatgaaaatgcgtgagttgaatacccttcagcaagcagaagtgaaaaaaaatcatgtatctttctctttacaaccgaagaaagtaaacgcctttggtgtcgatcacataacaaatgtctccaatactcctacaactttattcacatcgacacgctcacagccagacactcgtcccggatatattccaagcaaccggtatacttatatgatggactcaccaagtgcgatgaagaagcgctgaaaagcatgcgtacttcggagaacgattctttttcttcttcttttggtttcgaacctctgatagcagttatgataagaatgttattacttacatggctacctaccgcgtatagtttataaagtttatagaagagaaatttacagcgttaccaatggtttgggaatagaaactttagcttggccaaggcatcttgagacatggcttcaggttttgttgaaatggagtacttcatggcatcctttagaccatcaccgttgttcataaattcaggaagttgctttgccatttctaaaatgacccgggatgccaaatggttagcatttttggcattgttctgtaaattacggataacagtttgtacagacactggttcttcttcgtctctccatgcatcataatcggtagacatacaaaccatctggtatagaatttcacattcacgagccaatttcgcttcagggatcacactcatgttgatgacatctccacccatcagacggtacatcttagattcagccctggtcgaaaattggggaccttccatacagacaacggttagttctctattgtagtgcaacaggcaaggttcttcagactctgggttttccagaatatctttgaattgataaatatactcagcaaatgacttggagaatggttcaccgaacacaacatgcccaactaggccttcatcgttgaagtaagaggactctctgatccccttggttctatcgatgatttgttgaggcaacacgaagtctcttggtttaatttcctgttgtaaagaaccgacagcactgaaggacaaaatagcactggttttcaagttcttcaaggcagcaatgttagctctgaatggaacccttgttggtgggtactcatgattcacaccgtgtctagcaataaaggccacatggaaatgctcagtttcatctgattttacacgagacaccgtgattggagaagaagtcttaccccaaggtgtttccatacacggaagaatggcaattggttccaaacaatccaaagtgtacaaaccagtaccgccaatgattcctagatcaatagtcccatcaaaagtctgaggtaactgcgtagaattcgtcattttaaagctgtagaatttcgggataacgttaaacttcctgacgaacgttttcataaaacgaataacgttgtaaagaggaactagaagagttttggttcaccagatcagatttgaaaggactaatttacagacagttttatttaaattaatgcatgcatgcgctcattgtaaacttttctgaagatggagatgagcattcgagagacaacgcaggtgaaaaaaaatgaataatcacgtgctcttcttctttttcttttgtttcaatgatactattaaaaagacacaattattaacagaacctagcttctaagactatgcttttaattgcataaatgatttttgtatagttgtaggtatactaaagttggaatttggaatttctggttatcgcagtatttacaggaatgaggatggggtagtcgaaaaccttccaaaccttccaaacattgatatatgtataaatattcttctcttcgcaaagtttcgtcataatgggtcagctgccattgtcgcattagattcaaacttcaaagccatatcccttcatacaggtcttatacttagcgatcaactcatcgcacttaccggattcttggccattaaatagaagacattcgtctctagcttccttttctggcttgcaaacacagcatggctttggcttagtagcctctgtctctgtcttaactggagcagtgttggtctcttgtggcattgtttctatagagttttgctgttgggatgtgtctggatattgaactgaaaggtatcaggttaaatggtgacagattaaagggctggtttcaataacttacctacaattctttacaaaccatcgacatgttagttgtattactaaatcctgtgagaagcttctcagtagttacctttttgaacttttaacattcagtgtctgatttcattacccggataatgctcatgtgacttgtccgattgattatctaatccgccatatatggtaaaaatgttcgaacgaagagtccatatggagagctgctggaagttgaattacaggctcgatagagttctcctagagataaataagaagttggtacattgtatagaatatcaaaaccaccagatcagctttcaatttcaactgattgctgagtttgcaatatcagtcacgtggtaattttatatctcctatcacctctcttatactcttcatccttaacttagggcagtaaaatgaaaagcggacagtaggttcagtttgaacatgaggtctcattaaagctagcagctggatccctcacattgcagcattaccgttccacgtatgatgatgtcaaagcttccctttttgttaaggggagactttgcacgttggaaacgaaaatttctcactgaattgatggagagctgaaaaaaatgtgaaataacaaaatgtgcaaaatataatgtttgatacggacatactgatgcactagattggaaattcaggtgcatagtaaaaccctacttcactctggtattgtcataacccaagtgctcattgaaatatagtgttacaacgattcaattgtgttatcgtgtttacgctggtgttgaaaaaaccaagtacgttgatcattttgcgttcttagttaatcactggtttttatcagactttgatttgacactatttgtaattaaagacaataatatatcttcaacagcaatttgtaattttaatttctgttgacaaaaacacaatcgattatagtctcacttcattttggcataatctttgtcagaagttggataataatcattttccttataataatctgtcctgtttggattcttaagtgctggtttatgggtacttgtattcatttgtaaattcaaccactcaagacaaaccacagtgcgagagaaagaagaggtcaactatgaatccacaaccgaaagaaactaatcgaagctccatctcctcgggagcaagaaacagtgctggcagtgcttcttcaaataacagtatctcaagtaaaaatagcggtagggagttacaaccacgaagcgataccgatagcgaatggcaagacgttggtatgcccacttttaaagaggactattccatagatgcaattacgaagaaggtgaaacctgggaaaaagggtttccattctgctatagttcgtgatgctggatcattcgcgcacaatcctcaaccacctttggcaaaaccggtgaaacccacttttgaaaggtcccggactgcaaacctgaccgcaacttcatcaagaggtaacctgccgctactttcgcgcacttccagtacgctgtcagtatcaacagctacttcacatggacataaaggaactaccaaaccgtcacgtgcaactaatttcttcaagaaacttaccagcaggaaatcatctctggcaagccaaggagggcctccagattcagataatcaaataagccaaggtggcagagtgtcggcttcagatggtgaacagcagtcaccctttcatcaacagtctctgcaacagcaagttcccactaacgctttgcggagaaagatgagcacattcatacatggttcttcaaccatgtctgcggcgtctactttgacatccgcaaatgctcctcatatgaaacactctgggtctaagggcagctccctgttacattcaggtaacgaagccagcaatggttcaaatttaagcggtgggaatgcgacaagtggcgtttcgaaccaacaacatggagtaagttctgcaggcagaagtattgacacagacctgtcaagaagaaattcagggacctcatttgatgcttctaaattatcagccgctaaagaaatatttggtgttgacctagatttagacaaactttctgatatgacggatgtcgtcgttacttctaatgcaccctccgcagaaactacggacaaagttccaccaaaatcacctaatgcgtcacaagataccaaggatgctacacttgcgctacggaaacaatggactgctccagaatcctgggatgttgatgagacggtcggtcttgatgttaacaaaattaaagaaagacataagatgtcaaaggccaatcgacatagagggaaaaaccgcaaaaggtacagcaaatcacaaggaaaacataccaaggggtctgttccaaaaaatgtcattgcgaaagatacttcggagccagtaattcctcatgtacaccatcatgactttgaagaagacgcattgtcaccgcgcacttctcctcctaacagaggatcgaatgacgaatcgggactgcatttatcagaaacgaaaagctccgaatgcgatctttgtttcacaatttctcccaacggcgacgaagactcagacatttccattgaaacccaatcagaaagcctagacgatataacttctgctaagacgcaatctcgaccaggttcgcctctatcacaaaaaaatatcgaacaatatacagaactagatggagaaaccgaatacgaagaacatatgcttgagaagtattatagtgatctttcggatattgaccaaaccaaaaaatatgctattagaatcttcaatgtcgatgatactttcacaaccctttcatgtcgtccaaatacatctgtggccgaacttataccacaaataaagaaaaagtttaatattcaacaggggaatttccagttgtcgttgaaggttggtaaactatctaagattttacgaccaactgcaaatccaatcctcatccagatcaagttattactattgaatggttacaagaagagtgatccgctccatattttggggctcgaagatgtcagctttgtttttagtttcaaattccacccggtgaccacttcccaattaacaatagaacaacaacagaggctctcgaagggtgacttcattcatgttgacttgagaaacatggacttaactacacctcctatcattttttatcagcatacttctgaaatcgagagtttggatgtttctaataacgctaatatctttttacctatcgatttcattgaaagtgccgttaagctatccagtttgagaatggttaatgtcagggcatctaggttcccagccaacattacacaggcttatgatttagtttccttggacctagagagaaactttatcaaaagggtaccggaatccatctccaagttgtccaatcttactattttgaaccttcaatgtaaccagttagacagacttccatctggatttaagaatctcaagaacttgcagttgttggatatctcctccaatgcatttacggcgtaccccgaagttatcaataggtgtacaaacttattacaggttgatctttcatacaataagataaattcacttccactttccatcaacgaactaagtaagttggcgaagatgaacctatccaacaataaaattcaagctgttcccgatttgtcaggtatggcaaacctacggactctcaatctaaaaaacaatagaattgccactatcaaatcaaacgccccaaatttgcagaatttattcttaacctcaaacagaatttccgtttgggaagattcactacctaaactaagaagctgcgatttgacagaaaatcctgttacttcgttcgactatagaggtaatgtgttatctaaccttacaagtttatctctaaacaaggcaaaactatccagtttacctatcgattttttgaaaactttagaaaagcttgagaagcttgaattaaatgacaataacttaacaagtttacctgcggaaatcaagtactcaaaaaaactaattcatttttctgccgccaacaacaagttggatagtattccggaagaaataggagaactctccaatcttaaatcacttgatttacattgtaataatattagagaattacccatttcaattgtaaatttagagctaacaacattaaatttctcctctaatttacttggctacaaccccggattagaggactatgaaaatacccctttatcaaaatcattactatttctcaatactgctgacaacaatctcaataatgagatgcttcctttattcaacttcaacactagcttgaagataatcaatctttcttataatgatatttctgatatttctgcattaaacctaccatcgttgacagagttgtatctatccggcaatgctatcaccagcttgcccggtgaagtgttccaaagaatgaagaatttgaaggtgataatgttaaatggtaataagctgatgtcactaccatcggagctctctcaactttcgaatttgacagttctagatgttggttcaaatcaattaaaatacaatatctcaaactaccattatgattggaactggatgaataatttgaacctaaaatatttgaacttttctgggaataaaaggttcgaaataaagtcaatgattggccctgatactaaaacagatttgtccgacttgacaatcttaaaacagttaaaaattttggggttgatggatgttacaatgaaaacctccaaggttcctgacgatggtgtcaactttcgtctaagaactaccggatccatgattaatggtatgaagtatggtgttgctgatactttgggtaaaaagagctccgtgtcaactagagatatcaagtacgaaagatttagaggcaaggatgatgagtgcttgttctgtctttacgatagtgtgaatgaaaacgcctcttctggtcataaaatctcacaaatcatcagagacatatacgataagattttaacaagagctttggaaaaatatggagacgatactgacgaaaacataaggacagcattgcggttcagtttcttacagcttaacaaagaaattaacgggatgttggtgtctgttgaaaatggcctgaacaaatctgaattaactaccgttgatttgctcagtggtgcatctgcaacagtcgtatttttcaaaggcaagtcagtgtatacagcgaacattggtaacatcggagctattctagcgaaaaataatggtgattacgaggttttgactaggttgcatgttcctactaagagagatgaatatgaaagaataagaattgcaggcggttatgtcaatagtgaaaaattagatggtgtttctgaagtttctagagccgtaggattcttcgatttactgcctcatattcatgcatctccagatatttcggatttcaagttgaccttctcagatcagatgataattattgcatcacataatctttggaattatatcggttatgaaattgcatctgatattgctcgtgagaatggctcagaacctatgctggctgcggaaaagttgaaagactatgccataacttatggctgtactgataaattgacagttgtctgtataagtgtggaaaagggtgctactgaaacgaatagattcaatataagcaaaaaagatttgttatcgagaaaaactgcatttgaagatagttctctcagaaggcttcaacctgagatcccccctcccacaggtaatgttgccattgttttcaccgatataaagaattccactttcatttgggaattattccctgatgcgatgagaaccgctatcaaaacacataacgaaataatgcgtagacaactacgtatttttggtggttatgaggtgaagactgaaggtgatgcattcatggtagcattcccaacacctacgagtgctttggtctggtgtttaagtgttcaattgaaacttttggaggctgaatggccgggtgagataacatctatcagggacggttgtttgatcacggacactagcggcaacaaaatttatcaaggtctttcagtgcgtatgggtatccactggggttgtcctgtgccagaagtcgatgttgttaccaagagaatggattatctaggccctgttgtgaataaagctgcaagagtctctggtattgctgatggaggacaggtcatgctcagtaatgattttatggtagagtttaagaagattttaagctaccaccagcaagtcactgaagataatattccgctcgcaaaagcctacggggaagacattgtgggtgaaattttagaacgagaaatacacatattatcgtctataggatggatgttcgtcgagcttggtgaacaaacgttgaaagggttggaaactaaagaacttgtcaccatagcatatcctaaatcacttcaagcgagacacactttggcaacacaagatcagaataacagtgttatttcagatgattttctattccaaattagatcagtgtccaatagattggagactgtcctctcctcagtccaaggtggtcttatcgggctggaaaattctgccaatggacgatatactacctttgatagtaataccaaacaggccgttatgaaaaactcgtccgaagcagatcttcttgcattccttgaccatttaatcacccgaattgaatcgtcagtcgtcttaatgaacttacgccaacaggtccagggtggtttaaccatatacaaatctggtgatgcaatgaaacagaaatcaatcttccaattgctggatgaccttctagccagaaaccaattatacatagaaaacagccataatgacgagagcgagcaacaaagcttcaaatcttttccggaggagtagaggacttgatttctttattgttacgtcgaaaatgtctcatggtttcggaccctttgattaattgtcgtgatttcatcaagaataatataacacatttccattacataagtatataaacatgcaaaactttttatttttgtgcttctagatctctaagttcgatgcttttccctggaacttgagaagctggctggctggcactggcaggtgcagaatcgtcatccaccataccttcgaaaaatgtgtctttcaactctctccacctggtaatccaagtcccaaggaaaatcaatatcagtgtagacaaaaattgcaagataaaccatgctagtgaagggaatagccctgtgtgtgtccatactactactagatttatagcatggattgtaatggcaaaatcccacgcgagtttactccttcccactatgatggtcaaaaaaaagacacaaatcaaggaatcaattaaccaaagggctgataaagaaataccaaaagagtttgagaaatcaatgtcctgccatgtaaacaaccattgctttagctttatttcgtacccacatattttcgcccagcaataaaacaaagttgatgcagtgagataatagaacatttgcaagagtataatctgaacgattattttaccaggggactgagactcttgtttgaagatttcagtgggtaatagttctctcggaacacgcatgtatcgtctaagcgaagccatctccctgattggttgaaatgtctctaatcggtcgcctttctaaaactgcacttggtacagttcaattctatcaaatataactggtgcgaacaaccaaaagaattcaccgaatattataggaggaatgcaataagtaacgaaagaggactaactactcaattctgtctttattttcaagtctctcaaatcatgtctcaatcacaactcatcttggatttaatatgttgcttagagattccgaactagtttccatgttgacaaccagtggttaccctaacttgacgatatgtttttcctcaaaagaaattttccatgttcaagcttttcacatctggaatggcgatgagatgagcttgagatgagctacgacaactagaataacttagcagtgagtactgttcattgttccttattataacttctacaggtgacatactatttatctagtgctattattcttcactcatttctactttgcgagaaagaatagaattcttgttgttctttgattgagtattaaggtaagtggaaaataaagagatatacggcattcgttaatatggctgttaagaagtttagatcattcgatgattttgttcctacaattagtgatagcgaagaagatgttccagatttagatgcttctgatgacgaaatggaaaagaagccagtgaagtcctcaaaaactaagaacaaatctaaaaagaaggccaagcaacaacagggatctcacttggacgaagatgtccatgaagatttgaatccagaattccaattctccattgacagcggagaagttaccaccaactttgcaggctgggatttccaaggtgatgagaagagtgatgaagttgagaaaaaagatgtcgatctagatgggatcattagaagaaaaggtggtttgattatgatggctgctacaggcagtgatgccgaagaaagcctatcagaagagtccgaagaagaaccagaagaaggagacgaacctggcgagagtgatgatgaagatgaattagctttggatgggttcggtatgggtgtcaagagaaaggcaacagaggaaaatgaagaagatgaagaggatgaagaagaagaggatgacgacgaagatgacgacaaaaagaccgaaatgagtcaggcagatttaggtaagggaaaagacgaagatgaagacattgaagaagacactaaagaagaaatggctgaattttatgctccagaagaggaaagtgcggatgctaaaaagatcgttcataaaactttcaacagcttgtcgttatcccgtcctgtgttgaaagggcttggaagtttaggatacaccagtccttctccaattcaaagtgctgctattcctattgcccttcttggtaaagatatcattgccggtgctgttacaggttctggtaaaacagctgcttttatgattcctatcatcgaacgtttgttgtacaaacctgcacatattgcatcaacaagggttgttgtactaactccaacccgtgaattggctattcaagtggctgatgttggtaaaaatatcggtaagtttgttaacggactaacgtttggtttggccgtcggtggtttgaatttaagacaacaagaacaagcattgaagaccagacctgatatcgtaattgccacaccaggtagatttatcgatcatttaagaaattctgcgagtttcagcgttgattcagttgaaatcttggtcattgacgaagctgatagaatgttagaagaaggtttccaagaggaactacaagaaatcatgtctctcattccaagtaagagacaaactctgttgttttctgctacaatgaactcaaaaattaagcaattaatctcgctatctctaaagaagcctgttaggattatgattgatcctccaaaacaagcagcagataaattgacacaggagttcatccgtatacgtaaaagagatcatctcaaaccggcattattatatcaattgattagaaagttggacaatacaagccagaagagaatagtagtttttgttgctaggaaagaaactgcccataaactgagaatcgtccttgggttattgggtatgcaagttggtgaattgcatggttcgttaacccaagaacaacgtctacagtctgttaataacttcaaatccttacaagtaccagtcttaatctgtaccgatttagcttcgagaggtttagatattccaaaaattgaagtggttatcaatttcgatatgccaaaaacttacgaaatttacttacacagagttggtcgtactgccagagcgggtagagaaggtcgttcagtaacctttgtaggcgaatcatctcaagatagaagtattgtcagaagtgcgatcagatcagtggaagaaaacgctgaaagtggaaaggccttgagtagaaacgttgactggacacaagtcgagcaagtcaacagcttgattggagcaaagggtgatgttgtagaggagattattgaagaagaaaagcaagagaaagagatacttagagctgaaatggaacttcgcaaaggtgaaaacatgctaaaacacaaggaagaaatcagtgcaaggccaagaagaacctggtttcaatcagaagctgagaagaagaactctaaaatgcttcaagttttggcaaaaaacaaaaagccaatcaacagtaagaagagaaaacagcaagaagcattggctgagaatcctcggctatataaaaagacacaaaaagatcgtgtcgaatatcaggaacgtcaatacagcaagaagcaagctgcctacggaaagaagggaaagaagggtaagaaataaattactgtcctatgttcttagttttggcttaattatcaatgcgcatgaaaattcattatatactacataaacgcagttgaggtgttattacataatcatcaactctcattcgtaatatatacccatcgagagttgctttagagtttctggattgtaataaaagtcatccgtttcctcctctgagaaggattccagtgactcatcatctctaaatttatcatcaagagcagcaagttggacgttccttcttaattttattaatgtatcgatttgtttctcagtttctggtgataatttggcgtgtttactttgtgataataattgtaaaccatccaaccaggtgtagaagctctctgtactctccaagtaaaatgcagataaaattttcccgtttctgtcaaaggtggtaacttctctataaattgtgttctgaagaatattaatcaatctaacaccttcaggaagctttctatcgagttcaatttgcctactttgaatgtttataatattctttaacggaatgacagtagttttgttatttaccatggcagagtgatcgatggtcactatttcattatcttcaacagtgggtgtcttttccaccttatgtttgaattcttttatcaataaattcatctgattatctgataatgcaataaatgaaacctttggtaatttatcctttgcttcaattgggttctctgagtacacccatgtacccttctgcatcaataaaagtctttggtagcgtacaaattcctgcacttggttttgtaaaatctcatcaaagctactaatatcttctgcccagtcattgaactgtttttctctccattctgctacctgcagctgtcttaaatcttcgtacgtaaatgtctcacatacctcaacgaatgtttcaacaaaagaatcgtgttttgtgcggcatatcttatctgccttatgaatcagtattttaataagttcaagcaaagattcaaaatcttcttcagtttcactcctggacttatcccatagcgtcaccatagtaccaagaagcacggcaatgatttctttagtgaaaaatatgaagtgcatcttgtgaacctttgagcctaatttcaagtttgacatttcgaagtaatcccaaacaattacggataaacgggcaacagttttcaagagtggtaaaggatattcttcgaacataagttgttctgtgtaagcttttttgaatgttagatcgttttgtcttaagataaatcggatgttaagcagttgcaacactgttaggccgtccaaatcagtgtactcttcatttgatttcataaacctctcctgggtgatttcatagacgtcaaaaagtttgtgtatcaattcctttaccacatcagtcgcttctaaatcatattcattattaggcaagtcttttactgctccttttaagcgtttcaactggaccagaaactgttcaatggaacctactagatccttattgtgctcatgcgcatacaacagacaagacaattcgttaagaactcccacatcctcaagcatcatgttagttcttgctacaaatgtcactgcagtcttgtcgccttctgaaacccattggaggatgcattcaacatgaagacataggtatttaatgatttcctgacctgtagttggattattctcatatgtctttaaaaggcaaacaaactgttctaaaagatctggaccagagtgtagaactgaacacagcacagttaaggaaatttgtgatgagggcggatgtaacaccaagttttcacttagtagagtaagaactgacagtgatgcgtgcagagtgatcaggtctttactttgagtagaaatgataagaccatataatcgactgattaattcatccgtaattcttggcttccacagatcggttgcagccaattccgataaatgtcctaacccggttaacaacaatgcttcatctgtttcgctctgtgagaaagctgatgcaataatcacgtcaagatacttttctgcagtatcttgctctagcataactccatggtcattttgaaccttatggttctccatatcatgtataattgtctccattatgaaaatagtctgtatgaagaataaatggctggtcgctttcttgaaccaatacagatcaacaaggccctcttgatgactcttgattgtcttatacgctcgagaagatatgatgttatacaagttttaatcctgagatctgtttttgagatgagaagtaactgaatcattttcaatttttcacagtgttccccagagaacggttttgtcagatcataaaggaatgccacagagaaagaaaatggaataaataaaataaaagggccagacgaggttcgaatggaggattgaaatgtgaaggttttacgttaagaaaagtgagcgaagaatatctgacaggaaacatcaaacaaaactagcagtgatttacagtaaataacagatgtaatacgccatctctaggacgtttaacctcaatcggacacttattcacgtctagaaatttgctttaagtatatttgattattttaatttttatattatatcaaattgatcaggtatacacgtttccggtttgggttcagattataaggaaatggagatgtctgagcttcttgcaagcgaagttgtatcttccggcccggattacgcgaaaaaatctgtagatggattgaatatgactgcagctaatggaacaaatgatacattgatgactttggacgagtatttgaataaatcgttgcccttacaccttgagcagttgattttggatgccaatcaaaaggaactatttgattcagctgcgaaatcgttactatcatcaactttgttggctaaacagcagcagtcgctgcaaattgcgcccattcagccccaatcatcgttctcttcccagtcatttgctgagggtctcatagtgggtcaattaagtgtgatagtagctttgatttttgttatcaaattcttcgtgtttagtgaaggcggtactaagacagctaccgccaaaagtgttggttcagcatcatctttcatggattctactaagaacagcatactttcaacaattataaaaagaggagggaaggatggattggaagttgatgataaggacaatgaaaaatcaagacagatcaattcaatcttggaaaagacatactataatgttgaaacacactccccagaatcattggactggtttaacgtccttattgctcaaacaatccatcaatttagggaagaagccctacaaaagaataatatactaaactcattgaatgattttattgaaagaagatcaaacgagcttcctcaatatcttgatcagattaaaattacagaggtagatattggagatgatttccccatattttcaaattgtataatccaatattcacctaattctaataagaagcgtcttgaagccaaaattgatatcgacttaagtgatagattggctctggggatcgagacgaaattattgctaaactatccgaagccattttcagcagcactacccataaaattgactgtttccatcgttcgatttcaagcgtgcttaacagtatctttaacgactgacgaacaattcgtaccgacatctgaggaaacaaatgatgatgaaatgggaaacgataaaggatattatttgatgttctctttcaatcctgaatacaggatggaattagaggtaaaatcattgattggtgcccgttcgaaactggaaaatatacctaaaattgccagtcttatcgaatatcagataagtaaatggtttgtggaaaggtgcgtagagcctagatttcagtttgtgaagcttccaagcatgtggccacggagcaagaataccagaaaggaaaagaccgacactgatgattctgtttcagtgaaatctaacgactaatcgtatggattacctactacaatgactttaccaatcttgtcaacaaaagcattttgatgtgtaaactcgatattgtatctcaattgccataagttagcatcagaaattgcaaacccgttatcatccaatggaatccacatcttatgggttttaggttctaaatcacgcaatttgaaatcttcctgctgatgctggacttcatccgatgccaaacttgcaggaagatacttgatggtcgatttagagaggtttgacacctggaagtgcgcactgatagtgaatatcatgaaaatgaacataaataatgacaatttaaaacaatttgctagggcaaatagccctatcaaacatgcctcaaggaaatatattccagaatacaattgcatcaatgcttgtggatagaacttgcccaatgtctctgatttatttttatgatcaaattgatacttcaacgaatatttgaaagagaacatgacaaaaatgaaagaaaaactagccaatggtagtacaaatggtgcgataacggagtaaataattgtaatacttgccaatactgaaaaaatgggatataaagatccccactggtaacaagggacatttaatttgtacttcaatttttcccttggtgttctgtttgaccacctataatagaataaataaaagaaaaggttcttcgactgcaaaagattaccaccaaagtatgctatacctctgatcaatacaaatgaacagaagaagttcgaacatttaggtaaatttgttcccaacaaatgtggaatatttattggattattcaccactgtttcaacaacaactgaaatatcagaggaaatagttacgacgagaaatatatgaacaaacaagaatgcaaagaaccatttctgaacatccatttcaatttgtgcaccagttttcaaacatttaaccacactaaaccacctaaagaaaagaggcactccttcagtcaagaagattaaagtaactgctggcacaatgctggcaataggctttgacataaattcaggcaaatcctggaagtttgttagaatgggtacgattttggtgataataggaatttgggagacaaatccaacaatggcgactggcacaacccaaccaatgatgatcgcaacgtttaagaaattcgatattgcaacccttaatagagcccaaggtctatttatggtttgaatattgcaccaaataatatctgttggattaatacctagagctttatcatcactcatttctgagtccttattagataacaacatttggtcaaagatatgtgcaaatgatacttttctgaaaactataaaagcttgtctggaacttttcctgttaacgtcacattccatctcttgttgcatcaaagactgttcgtacttcttcatgtactgatctaatttaatttgcttcttttctattatttgttgagcgctccattccaaatgacctggttcaaaccattttgcttccttatcacgttgaaatcgaaaccccaataacatattaccgttgataagttcttttaagagaaataaagttcttttccaattataaacgagcctgtggtattttattttacaatgcacccttttatgatacatgtagggaaattgatataaagggaaacgtgccaaagagttgcgcttctcataatcaatgggtaaatcataggaagctgctttagaagctggtaaaaaagttttcgttaacatgatatccaattgtctattctcaatctggtttgtcaacctatctaattgttgaccgagagcttttgttacttcccaattatcaggtaattgcacaattttctcgacacaccctggtattaaagattcacagaaatactctattttatttttattaaagtctttgctgatattaccgatataaagaacgttttgatgataactggatgcttcaattgatcctgttagaactttatttctttcggagacatagtacttcaattcccgaagcaatacgtgatgaaaaaaacacaccaacaaaaccgctaaaatcagatgaaaaaccaaacgattactgtgagcgggtgatatatttgacattgaaatcttatccaatcctgtcaggccatatggtaagtgattcaacatttcatcattcgttaatttatcgttaagctccatttgtgatatataactctggatatcagcagttttataccctgaaatgtaatgaatgggaattaatattgggatgatgactatcgacaatataagaaagaacatagatagtgttttcaataaacgtaagaaaaaataagcatccaatcctgattctcgacattcttcaatagatgttgtccaagtcggtttgatccatgaccacggtttgttacccaatggtttcgctagtgatcttttattctgttctgtattcccacttgcaactgtgtcattttttttatttggatacaaacttgtgtttggctggtatatgtgagttaacctatttcgcaatatgctgaagagtatgacttggattatgcaaaaaacaagagacactaaaacacctgaaatgaatgaagaaaaggttatcccaaattgccgttgtgcactaccagagcgcgtattggataataaagttttgagtaaccccgatgtataatttctgtatcgggattgcaaaggagacgtttcttctttgtaattaagaaccaatattgccgtgttgtcatcaacttcaacatatttatagattattttccttaaataatccagagcagtaacatcgttatcatgattcatctcaaagcctagttggtccctggccaatgtgtcggagacgaacccaaccaagcgcggttaatattgatgaatagtagaagtctttcatgagctttgtgaaatgatagcttttcaccccactatgttacatgtcacaaaaaaatgacagcaagctaaattgtttgacaatcaccaaacaagacttttatactaagaaagtaattacctccaactttgctatccagtgcgagtgaattgttatcactttttgattttggggtcatcagaatgacgacagcattaatttttgtgatcatgatctaatttaataaactattttattttataaaatatataactttacgtggatagtgaaagtgcttgaaataaaagcttttcctatattaaccataatttaatgattttctggatgtttcgttatgaagatgtgatcaatctgagatagtccaggttgataaccagtttaggtattcgtaatcggtgcttggaccggacataccgaaagaaattggggcaaagtagtagaagccataaattacgatagccatgtatgagccataaatggtgtatctcattacctttccgcacttagatttgttccatttcttcatcgagatttcgaacaagtatgccaacactaataaagcgaagtataatgctggcaagtaatggtggacgtaagtaactctactcatgataataaatggaacaaagtgcaagccccaagccaacaatggatagataccacccatcaagaataaattaatatcttctggatttgttaggtcagagtattgacgttgccatctaatcaagtacacggcaaccaaaaccataaatgctagaacggcgatagtagatggccaggtagaagctggtgaaccaattaagaaatatttgatgttctgttcaccccatccacaaagtctgataccgacatttagagttggccattgccaagcggaagatgctaatttgtccaacttttcagcatttggaaccaatgcgttgttggtagccatcatagccaagttcagatgaataaaatctttgatgaaactagtctttgggtatttgaagttttcaggtcttggaggtaatttttcgttgacgttcgtttcaatattccaccaagttctcttgtctctcttgaaaggattcttaacacaagcgacttcattttgtctaaaaccccattgtggcaaagtgtttcctgtttgagataggtagcaacccatttccgcatttttcaatctgaaagaagaagtcaatggatgtaattttgtttcgtcttcaggacccttttggtcaacgatttcgatgatccagtcatcctttggatcaccaaccttagcatcaccgtaaccggaaacttcccaagcattggcttgaacaggggctctatgaggatgggtgtgtaaatttcttcctgtgttgagatgaactaaacggtatctagcaccatcggtgacaaactcagtttctgtttcgtttttgtcatatggtgcgctgaatctttgtctgtcaaacgtccagacgttattactatctttgtggccatatgtggtaacttgttgttgctgagaaccttctggataggtctggatatgagagtgcaatagaccacctcctagggcctggttcttgatagtaatttcagatgaacctaaagcgacgtcacgtggcccttcaccaacatcggaaccaatcaagtttgcttggaacaaggatggcatattagcatcaccagtaccagaatgggacaaaagatcgaaatggatcttgaaacatgctaaaaatacggcaaatggaaccaagattaaaaacacaaatctggaagcccagtgagcagcgtataccttttttgacatcttagtatctgccaacatgttccatagatcaaccactgtgtagatacccaccatagtaatgatcaacagaccgaccatcttaacagagatggtacaaccaagagagaacccagtgtagaataaccatttccaccactttttagtgaacggtttagatctaacgttgtggaacttcacgaaacaaaacatggacaatacagtgaagaacaaaagcatcgaatctaatagaataaatctgcctagcgtggtgtaagagttttcaaataaaactaaggtagtaaacaaccaaacggttggtaacgagaagccaattgacttagcagtgaaataagcaactggaacacataatgcagaaaacagagcattgaataatctcatcttgacaaaatcaatgtactctgggtattgctcaccagacgggaaatcccatgaaccgttgtaaccggccaagtaaccggaaaaaccgaccaacatcttacccagtggtggatgcacatcatgatagaattcgtgtcttaaatagtaagatccaaacttaccgaaatgtgcctcatcccaaacaacatggtcattagcgccgatcttgtacattctgatgaaaaaggcaagacctgtaaagataattggcatcaaaattgactccagtttcaacaatggactttcgttgacatgcttctgctttgaaagatcttcagcttcaggcaaaacttcaacttcctcaacaacatctttgcctctgtgtctcaagctgctctgcaactcgtctccagataatgatgctgacatttcctgtaggtcaattcgtcttatcgggcctttcaaactaaacaagatcaaaataatgaacgaatttttgcaacattcacgaactgatatttacttcagttcatgttaatcaaaaaaaacacttcgttaactttatataatatcgacgtgttcagtttttcggtttttttcaagaaaaaaaaggtgaaaaacatcatatacaaggcaaggagctagtcatgtgacctgcatggcaacagggtcttgcaatgtgacacgaagtagttagaactaaggataataggagtgccgatagttctaatatatagtagatagactttcactaaatttctctctttaacagtgaatattatagtatattacatctgtgaaatgatatatgcaaataagtaactgataacactgccagacgctagaccgattgacaaaaacacattggtaatgcctcctgcggcttttctttcgtcttctgtatctaatgatctgccgacgttcatgaaactacagctcgccaagagtccgttggtcaatccaaacatgaattgccagaaactgtaggatagatcgagaaacacaccaagatgtgaattctttctaatgtttcttacgttgaataggaaaaacaccgcaaccattaggatacgtagctgagagtagatgaatatcttacgtggagttagcattttggaattgaaagtatgttctgcgatgattcttccaactaaatcgccaatgttccaaagcatgaatatgaatggaatgaattcagaattccttaacgggaatcttaccacgtacgtgtttgatgcaaatactgggaaaattaacgtaacgcagaagatggtaaatatagagagcacaaggtaccttaatttcaggaaaagcactttgaatgggacgtaaaccttaggctcatcagctgtccgctgagccatatctcctccaatgataggtatatcactttttttatatgccacgatggatgcaaacgacatgacactagtggataagaaatatagattgatacctgtcgctgtttgttcctgtttttgattgaagatcgagaccatgaagagcactagcgacggtagtacccctgcgacggcttgtcccaccatcactgcatgattgtattctggtccgaaaacgttagccatagccatgacaccggtttgagagagtgcagttgcaacggaactgacaagcactagaaacataatcatgatgaatgacagtaagtgggataaccaacgatggaatagtaccacaccacataatgaagtaaatacaataatttcgaagaacaatccactaacaattctttcagtgtaatgatgttgaattttggataaaattatgttagacagtaccgatgatatcgtactaactgtcatcatggtactgatgtaaatccttgcatacaccgacgtgtcttgaaatacatcatgctggaaatataatgacgcacttaagaatgagttccacggccaaagtaatgcaataccgataaggaaaaatgcaagataattagtatcagtaagcttgatgtatgtagattctttggaaaggtccttggtttgtatttgggaaataggatcatttaatgcagttcccgttattggagtttcgtcattttcttctagttccataattcgatgaaatatttggtgtattaattttccccttgagtctatttattcaaaatacagaccagccaatgtatatattgaccaagtactaattaaaatcccttcatcagtaattttgtagcttgcatcattatgttttcccataaaacaacaattttctgaaggaattcctgtttagtttccaaaaatatgataaggaatttacaaaaaaatcacttaatccgtccagagacaggaaaagaaaaagtgagaaagcctgtcagttatacttggaatagactttaaaacattaatatacagaagaaaataaagactaacgttataaatgatgaagtattagttgaaatgatgggataaaccggttttaacatcctaaaaaaaaaaggcacttcttagaatatcatttctttggtggattttaccggcacatatggttttgttgtatcaattgagaaaggacacaagatgtctgatgtatcttctattgataacgttaaatgaaatttacaattacaagagcaggatgaaagtgaatgtggcaataactggtatagatatcttgataaagccagcaataaagggaacaaaaagaagtgaaacatgattgtaaataaaattagtacaattacactttcctgctggatgtttgggtggcgttaccccttgaaatttcaaatcttgtgacaagagggatgtggtcacttgggaacttatcgttagggaacccaataaacttggatgcatactcctcgtcgatcttccctagtaatccgcgaacacgtagtgattgagaggaataccagatataatcgatgacgtcggtgaaggagggtgtcatatttgtgaatggtagttcaccaatggcgccgtaacttgatctgagcgacaaattatgcgagaaattcttctgtgacatataaccgaaatctctttgatcaatatctttatggtttgccgtgacgtgaccactgttgaataattctacaacagcagagtctaattgggagttaaaatcaccacagatgaccataggaatcttctttatgtcattgttattgtttacatggtggtgctgtttgattaaagtctctaaatagtccagcatcacgccaacttggaaagttttaacatcattaaattgtggatcccaatgtaaatgagtagtgaccacccacacattttcgtttgtattcaaatgctttagttctgcgattagcgcaacattgtccttattcatagcacgattcaaataatcttctgtacgatggaattttttatggcttctccaagcagaactaaaatcaattgaatcttggaagaccaattggaattgatccttcttgtagaaaatagcacaaccatcgacctttttggaatccttggcgtgcattgtcttggctctggtcttagcgtggaacaagcaactatagttatatttttccataagaggaacccaatattcctcatatgttaaagtttcaacttcttgcaaacatataacatctgtgtcaaaatctagtaactgttctttcaacttttctcttctgtaatcccagcttaacgcccaagatggagtgaaacggtacatctttggagtagcataatgatgacacaacgtattgtaagataacaatgtgaagctattcttcaataaagtattgttcatgtgatttgtattctcttgtaatgactcgtattcgttagttggctcgccatcagctgatatttcaataaattttctatccttggcatatgggatttcaggcgcattatctctgaggtaaaagattaatccagtgacagacttttcagctataattttcacgagttgtttatcaagaggattgccctccaaacccaaaaactgcaagttaaacaaattaccaaattcccaggggattgttgtgatcatattgtcaaagaaatataaatatttcaactgatagcacatacctaactcttttggtagttctgtcaacctattatgagacaagtctaacactcttagatttctgagttttttgatggaagagggtaatgaagtaaggctattaccatttaaatataaacgtgtcaaaaattcgtaatggaacagtttttcgttaagattgaaaagggccaagttggaaaggtctaacgcgtgccataattgatcatcatgtttagagttcgttggagctaccatgcgatgttcaatttcatcgtcttcgtcgatattatattgagacagcttcttgtgttgcagaagtagagaaggtgtatttggatgaagctctgcttttggagtattcggagttgagaaccctgtagagtttagatcagaattgacattaacagcagatgcagtagcttcattaccggatgaggccatctccataagatgttgtttagtgtgctcgactaaagacatggatgcgtcattacctaaaggttgctgaccttgttgctgaccagattgacttggttgttgttgctggccctgctgctgttgtgactgaacgccatcttggccattagtagacagtcccaactgattttgattatttaagaacttcttcatggcgttttgtctagcatacacattcgattgacccaaagactgtctggaaactgcagccaattgaagctgtaacttccaaattggtgaattcaacaacgaggggtccgctaaatgtggatggcataacggattattagcattggacaattgctgagccactaacgcagcctgggctgcattaggtgttccaacattaggaggacccacagcttgctgtggtccccctgcaccgccagttatcacattctgaacctggttcatcatcataggaaggacattgtttagttgggccggctgatgttggtttccttgatttcccatcaaacctggcggatgctggtgaagctgctgagtaacagcttgcggcgtacccaccatctgaggcaccgcttgcccagcaggtttctggaatcctgacaagggaggcggataattcatttgcaccaattcaattataatgtgttgataatagtttcaatttttttcactgctgttattcgttgattcctgtttaaacttctattcgttgttatttccagcttttctaaatatcaatatcagtttagaatcttacaactctcaaaatatgcccaatgaccagttcttatttcttaatatgttttcggtttagtatctcgattatattaaattctcctcttatatcaaataaaaaaagcacagtcagtacagtaataactagtcgtctgatgaggctgtaaagcttccttagttgccgaagtctatgtcttttaatgtttaatgttttaatttcaatataagatttatttagttctttcaaagaaaaaacaaagtcttaaaaaccgtttgataaaaggaaaacaagaaaaaacactcagtagaacctgtgcagaagtggaaacaaagagaggtaacaatattagtgagtggtaaataaagaaccggggcacaggtagatgcacaattggtgtagctctgatctttaaatgccaatgttcttttctatgttgttgagaatattccagtttctgtaactatcgggggttagagcttgcttgttactgaagaagtgacagctgttgccactctggtctcgatacgctctactctgagctttcgtcattttgatcgttttattatattacccggaccacatatctgattatggcgaggattatcaacagttgtactattacccggacttaatttattcgtgtaacgatacgcgggttactattgttcacggatatagcaagatagcataacaataaaacagtacaagagattcctgatttgcgatagttataataggtgctctaatattacgagcaatacccagttaattgcagtaaataaaccatttacagttactaaggccctatttcttgtgaaggacttatgtataaaaagaaaaattgaacgttttaaaataaaaaaaacgaaaagtatctgaaagttcatcgcacacaacatacttacaatatgataactcgttattaacagttgtatcgtttattatttttcttctaaaaagatcagtaagaacttggataagtgattatctgggttcttgcaagggacttttaaagaaactgggctactaatcatcgtattgatttatctttctctgttgttttcgaataggaaagtgtgatttttactttgatttctagttgtttgggtgatacgagtctctagacatcaataatcaagaagtctatacatattttccatgtgagccgcctggtattttcattaattgccatggttgtatattttatattttcaacatgaatatgggaaaggtacttcttaacattttgttacatagatgcatatatacattagagagcgttcttctctttgctaagagaaaataatcggtgctcacgtaaccaacactaaccatgtggtcgcacatcctccgaagatgctaacaactttttcgtattttcctatcatattaagggggctgataacgttactcttgtcattgatcggatttgtctctgtcttgaataaagacccacaattaccgtgctctccccagccccaacaatatactttcatgtcagcagtagttactaccccatgctcactaccagtaacaaaatccagagtttctgaaggcagaggttcttccaaaaactggccatgagaacctcgtccaatggatataagctttcgttcaccagtaagaatgtgtaacgaggaccacatagagtcaatcttggcaattgatccgaaatcatgcgacaactgtgatatcaattcgggaagttcttttgctaatgacccttttataattaatttattttcagttctggaaagtacacaggtaaagtcctttcctaaagccatctcgatatcagacgtatccccctcataaatcacctttggttcctcaatgattttcaaggctgagtcgtcacacacttgtagcttcctattattgccccatccgtatatcttctccggaacaaccactacgcaatgctggaaagttgcataacatcgggagccttttggatcttcacatcggaacagatcaatccattctgtactgtgtttcaacctaggtacccctaattcgcctttatcaccccttccacgggttttaacccagccatcctcatcaataactatagtaacttcccaaccacatgcaatatcgagaaatttccctggaatagggatccattcgagacttattttaatgtcactggaagcgcattgaccagaagagttatcgccacaccaatacaacgacccatcttctaataatagtagcgaatggttgcccccacatgacacttttttaataccaacaccatcactttgaaagctcaattgaggcagcatcaagtcctcatcgtgtcctacacccaattggccattcccattggaaccaaaacatagtaattcgtaacttgccatatgtcaagagaaacacaatattacgaatgagcacgccgatttgagtcggtatggctgtgtcaggtagttgcaagtgtcatgacataccaaaacaccacattcgtttacagctgatgcacatttgatatgcaacgagtagtagaaaaggctaaatgcagttggctgacagatttccggtttctatctggtaaataattcctgtcagtcatgtgacaaaaaacataagcagcccggagcacatcacacctgatcacgcccggggctctctgttttctccaaaaaactgttaacacgttcggaaaaatgtcgtccggataaacccttcataatttttgggaatctttaccttgaatatagacccacttcccctaccatcatatcttattctcgaccttcgcatctatggggccgaccgaagcaacttttttcgtagtaaagtgggagacatgcggaaaaatttgtaacgtggctccttgtaatgcccaagattcaaggaatcgttgggcacaacgggcccggaacaatgttctggccaaaactcattgcggtgtacagatgcttaaattattgcatatgcggtccacaaaggatatcaaccctattcttacgtagacgaattcgttgaacaacacaaccaaaaagaaaatacaataaaaaaaaatctgggccaccggagcttttcacgtagtcttccggaaaaatatctcagtttcctacaccctttcagtgcaaaaggatgtctccccacatctgaaaaagttcatttggaataatattttctccctaaggaatgtctccaaaaaaaaaaaaaaaaaaggaagcaaggtatttaccgaccagtgcgaattgaccaatagttttaccgaagctggaaaaatgttgcgtacagaaaaggcagaacatggcataatccgcagttggatgatgagctgagggtatcactcaaaagctatagtcagagctcggaagaatatccagcaggttgtttccagagcaatccctggcttcaattcatgtagtatccccggtagagtgcgtatgccaaactcacgtctcaagtgttatgtaagtaaattcgttcgttaactattcatgttcggcaacaaacccaaagtaaaaatacaactggagatgtccccctaggcctattgccatacaattgaagttcgtacgctctttgtcccgacatatctgccgtttttattgaccgtatttcactgtgtattgtttattctccgccgtttccagcctcgggttttttcccattcacactatacagagtggatttcacttctgacatatatataagtatgcataatattatacttggctccctcttttaaccaagccatacgtatgattcccaaaaatttacttaagaatacaacataccaaattcctaccatatattgttctgtatcaaactgtcatcgtattacctgtgttaggtatcacttcaaacagcaaccttttttcaaatcaccatttgtgcgtcggtctttcttccgattatccacgtagaatacagacacaaattttttccgggctcagaatttttcaattttctagatatatccatttttcctttaaaaagaacactttcaaagagacggagattatcagacgtttaaaaagagaaaaagtaagaacaagctcgaaaccgatctcctttatcgtatattttttctgataaaagcaccaaaatcccataaagtggcttaccaggttggtcgaaactctggctggttaacagagccacatatttaacgaaaacaatttacaagaggaacaaaaaagtgaatcaaaaaccggccgtaaaaattcatttgcactaaatcgaaacggcatcgagatatacacaaatattctcctacaaagatgtttgtctcacctccgcccacatcggccacaaatctattacctggggtactcgcaaaaaggaaaaccaatgacctagctacgataccagaaggtaagagtagcagttcgcatagtctaccacaggatcaacccatgcttagtaacaatggaaagaaggattttgtcaatgcccctccagagtttgccaatagagctcgtgatgagattaagagacggctattacagaaacgttcaggatcaactggtggcgccaggtcattacattcataccgcagtaatgcatcatcttcaagacaagattatggatcggatgcggcgtccattattactgggctgacgatgtcatcagggacaggttcctcgattttctcgtcaccctctttcaatacaatttctacgcaacttactgatgcgtcatctgtgatagatcaacaggactcgaaacctttgacacttacactagagcaagctttaccaacaatattctacgacatgtacagcccagatattttgatgaatcctcaaaatttgatgagcaacggaaggccgaactttactaagagagaacttttagattgggatattaatgatataaggtcgttactcataatagagtccttgaggcccgaatggaacgggaaacttcctaccatagcattcaatcaactgcagggtaacaatggtacggaaccatctattcctgagttcaggttccagttattaccactgaattccccagatgaattcatcatatcgacgttggtaagttctgatctttatatcgaagctaatcttgactacgagtttaagctaaccagtgccaaatatacagtcaattcagctaggaaaagacacgaagagctaataggccatcacgaaccagtcatgcaactatcgaagcctgaatggagaaacattatagagaactacttacttaacattgtagttgaggcacaatgtagatttgatttcaagaaggcttgttctgagtacaaaaaatggaagttagatcaactgaaacaacaagctctccaacaaaacatgattcttcagcagcaaaatactgtaaagaaacctaatatgccacctccatcaataataccgaagaagtctaagaattcgctgctcagaagggcactactaagaaactctcaaatcaagatcgaggaacaattggaacttgaacagcaacaggctttgcaacagcaacaacaacaagctcctgtgccattagtcgaagtacctacgaaagtgtctttaacaaaagacgaaaagtcaatggtctggtcccattgccaactgcaagtgtaccaaagactaggtttagattggacacctgacaatgtcagtgcaaacagaatccagtcatgatcaattggaaattacaattacggaaaactttctcattctaatgaacatatatatatatatatttttttttttttttttttaatgctatcccttcaactgcgtaccaagctaaatttatgaccatatcttgcacagtactgccttaagtgcagttattacatcacatattaacagtatataaatatttattcgtttagttcgattgtaactagtattattcaccaggtagggtaactatatttcctccatctttcgttggtttaaaatttacaaagctgcagaaattgaaaactacagaagtattaaagacatagaatagcagaggtaagctattgaagttgtctttgctaatttgtgacactgcatacccatcggtgaaaccaaaaaatcacttcaagatggcacagctaagcaaagaagccagtgatttgatggctcgtttgaacatcaaagaacctgcaaaaaaggcatctgaggacaatgacacaacatctgaaactaaggttgagaaggaagatgctaaagagactaaagctgaagaaccagcaaacaaggttattaactctgaatacgaagtgaaggttaatcttgccgatttgcaggcagatgcaaactcaccattgtatagtgtaaagtcttttgaagagcttggtctatctgaggagcttttgaaagggttgtatgcaatgaagttccaaaagccatctaagattcaagagaaagctttaccattattgattagagatcctccacataacatgattgcacaatcacaatctggtacgggtaagacggcagcattttcattgacaatgttgactcgtgtagatccaaatgtcaattcaacacaggccatctgtctatcaccagcgagagaattggctagacaaactttagaagttatccaagaaatgggtaaatttactaagacttcttcacaattagtggttccggattcattcgaaagaaataagccgataactgcaaacatagttgtcggtacacctggtacagttctcgatttgattcgtagaaaaatgttaaacttgggatcaatcaaagtcttcgtgttggatgaagcagataatatgttagacaaacaaggtctaggtgatcaatgtatccgtgtgaagaaatttttacccaagacatgtcaattagtgttgttctctgccacttttgatgacggggtacgtcaatatgccaagaagatcatcccaactgcagtttctttagaattacaaaagaatgaggtcaacgttagtgccatcaaacaattgttcatggactgtgacaacgaagaacacaaatacacaatattatctgaactttatggtctattaaccattggttcttccattattttcgtgaaaacaaagcaaactgccaacttgctatatgcaaaacttaaaaaggagggccaccaggtatcaatcttgcatggtgacttacaaagtcaagatagagatagattgatcgatgacttcagagagggtagatccaaggtcttgatcacaacaaacgttttagctcgtggtatcgacataccatccgtttccatggtcgtcaattacgatctccctacactacctaatggacaagcagacccttcaacctatgttcatagaatcggtcgtaccggtagatttggccgtaccggtgtggctatttcattcattcacgacaagaaatcgttcgaagtactatcggctatacaaaagtactttggtgatatcgaaattactaaagtcccaaccgatgatctggatgaaatggaaaccatcgttaaaaaagctttaaaggcctagagaaaagtactgtatctacttttatatacattttccctattgataccttttacagtcataataatagtaatcgattagttgaaataaaaatcaacttgaccaaaacatggaacggtttcgacgtgaagttacagatacacatatttaccactatcattctttagtgattactggcactattggatgagggtcttcagcattggcatatctcaagaccctattgcaaaacagcggaaattctgaaagggaaaaatgaaaaataaaaaaacaaactataaaaataatgaaatggcaaagagtttaaccatctaataaaccttgcccgtataaacaaaacggggccaccagcaccaaacaacaacttcaagatggattctgctaagattatcaacattattatcggtatgtcagaatgatgtgaatagaatttcttttcatacttcctggaattgagtgcgcaattgcatagcttcgtgttttaggtacatatctgtgattgcttacttagtcattttattctttccgaaaccatgtttttactaacaaacgcaacaactattttgataaatgaatggcggtgccatctttagcctgcaaggttcgagttggtacacattacatccgatcaaaatgttttatgaacagcactatttttaccaccagtcgccgtctttatggcccgtggttggggttccgaatgtatccttgatatcattttgaccattcttttcttcttcccaggtatgttgtatgctttgtgggttgtcctacaaaactaaataaattaagtgcgtgcgatattcatcgttaactgtttcatcttaatctatttacaactctaatttgaactaattgtgtttcacagttcgatacattttattatattccctctcccattcttatcttttttttttcccttacaactttgatctttaacaaagcgtcctggtgcatcctttactgattattcaatattttaggaagagtgtcgacttatcccatttaacagctttattgacatttatttcactcaatgatgctgtaaattagtttaaaaccaaaaacctattataattaaaactaaaaaaagaagaaatagtcttgatgaaaaagcacaaacagagaccccatttatctagttttctagactatttatggcttgagttttattccctattggaaatgactcctgtctatcgtttgtaacagtttatatttcaatattattaaacattaattctttgctctaatacaaaaatcagtagtaatgatgtttaagttacacattatacttattgagtatgtatatatatacaggtcattaaagattcatcatatcaagcacacttccagccttagtttgtatttttttccaattcaatatgatttattgtttagccaccacaaatcgcatccgtggacaaggataagaaatcaagtctaatgagcgggattcaaaagctatcaaaattatagttgtggggacaacaattcaatgactgatgattgaatgaaagcaacaccagcagcaaacaaagcagtatggactaacactgggaaagctggagtttgcttgaattgatcgaattttgattcagaagctggagcagaaggagctggggcacctggaataccaaacattttttagtattgtagaactggtaagaatcggtagtgtctggcaaaaacaacagtaatcaaacaaacggtactagattgttatataaaggttttggacaatgatcattgtatgcagctaaacattatttcaatctcaaattttctgtttgacgattatcaacttttcatgaggaaatatagctggattggttccgggtaaatgttacccggaacggaatctttatcctgaacggttatgcagttcagtgtaacactgtgtgccgcaggcaaataaggttgcctctaccataagggaacataaattaatgtaatgtttattccgaacttacataaatatagatgttctattcagtagctttataaactagatttttgaataatgtgtatactattgatttttcatttattgttgagttgttagtatttgccattatttgacatttctatgtagtgtaataagaccagcttttttgtatgcgatttctgtaaatatttaaagaatgggatagcgtcctgaaagaaatagaaaggaaggttttataactcacctcgatggaacagtttatgtttcccagaaggaattccttttactctcccattaaagcagtttttccccaggccattcctggcaactctgtatgtgtataacgagaaatcatagcaagatagcatgaccaccgggatgagaaatagccatgctattgttctgcagaatgtctgaaagatcttccagaatatgtatatcaacgtcttgaacaaatctatcattgtcagtagatgctcatccatgatgatacagcgtttggagtattggatccccttcaagatgtggtgcgacccctgtgacttataattcttggccttttgctttttatcaatgtttagatcagatgatgaaagtggtaaaatttctttattggtgaagggagtcttttgccctttaaaatcttgaatttttcaatattcctgcaaaacgtgtataaccaaggtgacttctcttgccatgtgtaaaaacgagaaaaaactacaacaaaaacagtaggtaaggatttactgataaactcatcgagggcgaatggaatcttaagcaggctcttttctggtgtatttaattgttcttcataactaatttatcaaggaataaaaatacaattagttttatatctgaaagaatataatttatatattggaacatgcacatatggggaagagggcagcttgtacggcttctgcttgattcaagtttagtatttataaccaatcatggaatctcgagagaacaatgaaaccgctcggacaggagaaacttgaactacttacagatgggtaataattatagtctttgcagtaaaagaaagaaaaagcattgtaaacgtaaagtttccatgtgtgcagcagtatcagaatagtgttgaaaaatgtggtgctaacaaataaaaggggacaaaataactgtctgatgatctatcgagtgtggtgaattgattaaaagaaaaacggttttagtattttttttttttggtttttgtgtaatgattgtgtgtgtgtgtgtattgaaatggataagagtgttctatctgtatgtttcttttacatatcattggataccaataacggacaattcaagggtccatacccttctaatgtgtattttgacaggtactttcagtttttggattttgctattatctgggaagatggttaaagtgtcattttcaaagattgcagggaagtcaacttccaaatcaacgagctcttgaccccaccaacactttcttgcaggtttcttccaaaacaataatagttttgtgttgatgtctggtttcgggaccaattcgtacaaggttggagattcatttgctcgttgtcttgatgcagatctgtttcgtgatctggaacgagagcgaacattttcactgaatacagacaatctcgatttacgtttaacatcagtccgtgagggagttggtgttaacttcatgttagaacttgtgtcatttgtcattgtggacgcaatacttttttgatcatcgtcgtactttgccttagcgactgcgactgcatctctgaattcttgagttgtctcattggcaagtctacaaagagacaacgaacttatgacagtcttatccatctcttgacttctgttaccccacacagattcagttttaaaccctgatgaacatagcatatccatcaaatgttgttcagctgaccccaacttcacagtacctgtactggacttggtcccatcaacttgattcgattttgttggtttcttggccctattcgaggacttcaaccccaagaatacagatgtttgcttcaacaaatggctgccagcagccagtttgatttgcaccatcaagttatgcaagagttcctctttctccatatcagatgatccttctggatattctacggagacttgtggcacacaatagtaatccaaatcttctcttaatacgataataccaggtttttcatgcaagatctctgattcctgtgaactgcttgaattattcgaagaaccaaaattgaaaaagttattcccaccgcttgaactaccattggtgcctttacgattaaagatttcattgactgggaaatttaaataatctgtgtgtgcttgattgtacacgtccataatgtattcaaaacattccgtagaaaagttaggtatgtaaacttcatcatctggggtcaaattagtaatgatttgaccatccctatccatgaatacaccactggggaaaaggcaaagcaacaacgattctggcaaagacatcaattgagtgcgtgtgatgtaataatgcttctcctgaatattcaaatggataagtgtatcctcctcattatactgttcgtaatcaatatatgacccatcttgtccaagcagtgcaccagaagcacccccaccatctggagtaacttgcgttataatcgactgcgtttgaggctggttctgactcattgtccttctctatcaaaaattaaaaaaaaatagtgtccttaataatcgttccagtaaacaatatagcttgcaaacagaataacaattcacaaagatgaatcaacttgtaacttacagtcaatctaagatcagtaaatgaatcagctaacaatagaatagcccttttttccttttcttttccgtgcaagctacacaaatattataccaaaaaacaaagtgaaaagacacttgtagcttccttgcttcactccttcctttccccttagtaatactaggaacaggatagtgcgtcaaatatctcaaagcagaattactgattttcagctatttcgtttgccaagagtatccaaaagaattgaaattaaaagcgaacaataatcttgtaaagcactcatcattccaacactagaatgtacgaacatctaattatttcatagtattctcgattttaattttttttttattttttctctctttcaagttgctgctgtttcgatgagatggccaagaaactggtgaacaaagtcacggtagggtaatatacaaggcaagattgttgctgatgccgtacggcgttcgttttctgtaggcgacgagtgttcagattatggtgaaatcccacgaattaacgttgaatgcctagtttactggtataaatctgttttgagaccactttatcaaccctaacacggtttaaactctagtatttcccactgttgtcttttcgaaatgtcgcttcttgaattttagtaacagggaaaaactgaaaattttattggtctttcctatataagaggatgagatgatgtccttcataagaagtagccgagtttcctctacgtggctggaacattgaacgaacaggaataagtgaagggtaggtgccacacatattcttgtctctgaatacgttcagttgtgatggttcaattacatcttgatttgtgtgtttttttatcttttgaaggatcaaaagaatcattactgaatgtggattcatgtaaaatgtcttacctaactaaacacaggtatcccctcgagatgatgagatatatcattattaaccttatctacattatctgaaagtttaaatttcaattgaagataaacatgtacaacaatagctgaatttttttaaaatactcgatgtggtgacaactgtgttctggaagtagtaaatatacgtcttgttgcttgaggaaataatatttaagtagtggtcagttgtacaaacacaacctgcgattaaatatccaaatcagaatctgtgataatatcttgatcttctaacgtgattggcccttctgtgttcttattgcttgcagttggagttacaagctttacatcggatttttcttcggttgaggcagttttgtccgtgcttgtgtttaatttagaagtgggtgtggatcttgttggagattcactgtgcggtgccaaggttttcaaaggagaacggttattcttaccccttacttgttctggagtgtctatgtatgttgtctctgctacgactttcttggcccttgatggtaattggggtgggatatcgtcatcagatccaaaatctagatcatcgttgtgcaatgagatcccagcattttgtaatttcgtttggccatcgacgttgtcattgccatcacggtaacgatctccgaaggagttaaacctcgactgagaatattttggacgggattcggaataatttggatcgtcatccaccagattcttggtgatgccactgaaccatgtactgatctttttaccagtttcctggatattacggttcaaattttcacgaatctggggtaactccttatcgacgaaattactgaacacatcgtcttcaccgtcatcttcgaaattgtcatagccgtcagaatcacgtcttccctttggtggaattgcacctgctccgtacctcctctcgtaatcacgttcacgttgtctgattctacgctcgcgtgcggttctctccgaagcgctattgccatgtttgttgaatttcttatccaattgacgagccaattcttcgtcctgctctaactgcgtttttggctcacgtcttacaccacgagttggcgcttgcaccggtctagttggtaatggagcctctttttcaaagtcagggtccgatatgaataaaagagcgttgaaagcaggatccaactggccctgagaagcaattaacactgccttcacatatttctcctcaatgtttgggaacgcttccttcaattgttttaacataggattttccttttcactctgttcttctggagaaaccgattttcttacaggcaagggaggtgctgaatcgtcctcgtcctcctgaccgtgatcttgcccttcctcctgtttttcagcttttttcacgttctctgtttcggtttcagtgtctgctggaacttctgcttctacatttgaagccttagttgccgcttcttcaactgtttccttgacatcttcgatcttcttgtcttcattagaatcaacgtcaattgcgacgtcttcaactttgtcactcatggttatattagatctttctaatcaaaaagaatttgcacctgtaatttatcttcttctaatatcctggttggttctgtaattgaatattggcgagattctgcacggatatgttctaataggggttctggttttgcagtcctaaagaatctatatatattcttcctataattcctatttctttcccacatcatcctgtccattcggttatccgggtaagggccttattttttttcactttttcatctcatcacgtcaaagttgaagaaaatagtttggactatataaagaggaagactttaaagaggtgcttgtaatctctcttaatactatatcactctgtcattttacctttatagatcttgatatatttgtttttttttcctaactcctcggaatcttattattctctgtttagataagaacttggcgatcaggggtccttctaacctgatacatcgtcgagcgtggacaacagagagaaattagatgccgttggttaaaaaaaactttctggcatatagtttaacatagggctgaattcgtgccggcttgctggttcgtatgaactggatgttttgcatccaggctcttaagactcgaaaattttgggatgggtttctaagatcgctctatgtttcacgcacattttcacttaagcctatttttttaccgtagatcactcataaacgaattgtaaggcgttacttaataaatacatatagtgtggacatgtcatgtatcatgccttgttcttcatgtttcttaacttgtccataacttgggctctggtccaacaaccttgagaatctccgacttgtcttctaacaattggatcatcaagtctcataaagggattgaatgatagttcatcggcaatggtaaagtgaccagtggtgacttcgtgttccttggtaaaagattccaatttattgaaatggtcgttatcgcttttcttcaagtatatgtaattgcggatgaaacttacgtttcctgcagtatactcatgacctggatatactttcacattcttccaattggaagtatctcctgtattccctagtagtctgaagttcaatgcatcgtccatttcttcagcagttccttcgaaaaacctcccacatccaccagtgaacaaagtgtcaccggtgaagattgcttgttctttggtttcagggtcacgcacgtagtaacaagtggaatcttgggtatggcaaggtgttctaatacacaagattttcaagttccccaaggtgtattcatgtaagttatctgggatatcattcgcaattggagaacgttgagaaccggcaatgactcgagatatattattgcccttttcattcaaggctgcaagtgttgacacattgccaccagcatgatcatagtgatgatgagtgtttacaagagcttcaatgctttttgcttcatcactgccaagatcattcatcacttccaatgtctcagcaggatcgatcaaccaactctttttcttatcctgggtgctcaataagtatgaataattgaccccaccagtgagccacctcattttgatagccttgacatgcatttttcttatactttgctttatcatttgactctcctatagcatgatatttaataatgcaatgtgtgtaatggtgatatctagtttgctaatctgtattatgtacatttttccttaatttcggtatattgtgttttttgctccatcaataaaactatgagacgcgccagcttaaaagaaggttcaaacattgaaactccgtgagtatatacgttttgataccataatacatttataaatgggttcaagtatttatttttgattcaattaattgcaccaattcgtcaccaaatttttgtagtatatgctcatgcggctcaataaggttatgaattaatgacacttcttttctaatttcatcaatgttatctatctgttcctcatttactaaggatattctgagttgccgtagacttgaaagtatatcttgtggtttattcaagtttgatttcaattgattcgatggtataattcctcttttcttggtagttagtggactttccttcttcaaaggggaagaagcgggagttggatgttgaagtctcactggtgagaaaggtttggggttacgaacaggtgtggaaggcgctgacactatagtattagtgtttttgctgctatagctacttgataaatccaaaagtttaccgcttatctcgtccgcttcttcttctggtcttatttcccatgaaaataagcatccattccctgtaacagtgacaaatttattggcaacggttgtcattccaactaccggatctgcgtgagcatagtattggttaagacattttcctgtagtgtaactaaaacatcttatcgttttatccaatgaagaagaacataaaatctggtcactgtcggcattaacgtaaaaatggttaactaaaatcccatccccttggtcatccaacaatcttaataatctaggagtactgttcgaggttttatcaaatatttgcatggttttgtcggagcgtgacacaatgatatctgagtttgtcaattgtaatctcaatggagaattctttacggaaaggatggtttcttttgaaacgtttaaggtattgtcgacaatatctatccgatagcaagatacagtcctatcactcgaaattgtatataacttattgtcgcacatctcaagctgtataatattccccttattgtctttaactgtttcgcaaatattccattccccagctcgtagttctatgaagttcattgttctgtctctgctgatagtgattacaattttgaaagcatctttctcatatatttggataccgttaatggcagcgctgtgaactttgctctgatattcgcatacgttatctttgtatacagataacttccctgtggaatcaccaacaacaaaatagttttcattcacactgaaatccagagaagttatttcctcgtcagaagaaaggtctgatatatcaagttcgtacttggaaagtttggtgccatcaaatagcttgatgtctcctttcttgctacaaagaacagccaaatcattgttaatttttttgaacacttttatatcgtttagagatggatttgaaataggcttaattgtctcatttatgattgatatttcacccttagatgtacaaaacaatacagttttgttcgttaccagtttcatcatgagaattttatgtgtatcacgaactgaagcttctgtatcaacaaatttttgatcgaataaattgttctttattggacttgcacccctaatagaggagctgccacttcctggtctcaatctttcttgatggttcaaaacatgtgttaagggtatactatctacatattcatcatacgagaaccaaagcttgtcattgtcccaatctactagaatattgtcgtattgcttatcaccttctagttcgtaaagacttataagcgatccattctgatatagtacaacttgacgagaatcggttaaaaacaatagttgatcgtcacgtagccactcggagtcaatgaatgttgattcaatcaaagtaccaagcacaatgttcttgcccttgatagccgttcttgttctaggaatcgtcagcttattgtttgcagtattattggtgttttcaaacttccatactttgatttgcctgacaccatatgtaacaagagcagaatccttataccaatttagtcctagcacaattgtagaatttttattgctggccactaatcttatactattggtagataacttccatatgtgcaagaaaccgtcattaatcaatccaagactggtaaagatagtgctatcatcgggatgaaattgcaattgagatataccataactatgctgatgtattacgaataccggaaaatcattagaatccggtgccattgaatagagtaaaattcttggttgatgacctgtttcacccacaatcaaaaatttcgcatcagcagagaaacataaacatgaaatatccttaattctgtccttaattttagatggagagcatcgagctggtgataaatctgaacctattgtaacagctttctctgatgcctcatccgagtcattccaggtatcacctttaatactaatactatgctcaggctttattaacccataataatccttggcaatatttgtgggtgaatgggattcctgacgaagtgatttcgaagaagcgcaaaagaatcgttgtttgattatctgctgtgtatcgaaatccaattgtgccactaccacaccgcctgatgccgcataggcaatgagatcttttgctgcagaaaagcatgtcctcgagttcgaagaagaaccaaagatccttgaaatctttaggttatccaatggctctctcattgctggttatagctacttatggctctagttggaccattattttgtgtatttgcctttatatacaaatgatctgtgatctgtgatttgtgaaatgtctaatgttttcattttagtgtttacatgaaaagaacggtcattgcgtttgcagctatattaatacagagagcaaatgacggaagagtaaagagatataaacatatggcacatgttaataccaacactagtagcgcattgaattgctttagtgctaattcaactgtgcggtgatacttccgactttacagtgaaggttttgatcacaattctttatcccaaaaaatctgtcgcatgtctctgtttgaattatgggtagctgaaaccagtaagaaagaattcaagatgaaaaaatcagagaattgggcacgtacatgatttcattaccctgtggtcattaaagtagataacagttcttaatcagcgacaggcgagtcttactgtatcttatttattctctctttaaatacatgaaacaaaaaagtcataaattatccatcaacaatattcgtctttcatctccaatcgcattataacggataaaaacaatcagaaccattgcacgcaaagaatagtggataagtggtctacacgagactcaatgtatcgaaaaaatcactagaagtaactttggaactgtttactgaacttctaccccttgccttaccccatttatatcataacttttttgatcttttacatcatctaatccagagtaatgagccgatttgccaaggcatcgctgccactactagagataacagaacttttacaaaagggtttaccaaaggagccattcaatgcaactttgcgagatttcatagagtggaacaatctaaccaatttgcggagccataattttttcactaagaaatctgcagcccaaataaatgaagttaataggttacaaccggtattatctcattgcttcgcacgttggttgcacgttgaatacaagctcaactattatccttattacgatcttaatgttgtgtgcttatacactgatctaaatgctggcattgaaaatgcaaagcatgtagtaaattatttcaagaaatttgtgaccgatgatgtatatgacagattaaactactacttggtaccactttatgataccaaaattgacgcaatgactaaaagcacaaatgatccaaagatacgaataatgaaagaaggtattctatctaaccatatgaactatcagattgaggatcctgtttttgttaccatgataaacgatgtcgtgaaatttcttccctgtgatttggttcaatacgatccccagcttgagaaatggttacaagcatatatcgaatatgatccagaaaaagggttcatgaaacaagatttccaagagatggattattggtgtcatatgacagctaatcttttgaaattagacaaagattataaagggcatgaactatacataacgactcggctagtgcatttgtttgctcaattacaccgtacgataccggagcacaaactatttattattgacaatccacagagatggtcgccaaacatagctaccataatcaagctaatgatgggatgggaaaattatccaataacacaagcaaatatttcaagtcacttatatcaaccttggactaaggagaatctccttcatagagacaattcaacttttatcaccgatttccaacaagttaagaaattgtacacagagattaccgaaggtacgaaaactttggaatcggaagacttacatgatttcgctaatgagtggatggattatggtgagagtcaagaattattggatggtgatccaagtaattcaatcaatatagcaagacaatatttacatgattcgacattggctgtaatccgaggataacgggctggcgttatatatatgtgacaggggtaagtaggggattgcaacaattaattgattagtgtactttacatcttaagtatgtaaaccactcacattcactcaaataaacgattctgaatttgttgtacacattttattgctgttgttatattggagtgtgtaatgtggtatttctataattcctcataaattggaaagaaaactaggtaataggtggtgatatccaatgagattttcccaaatggtgaaagcatgctaatccgcatatatgtctattattaaaacaatttatctttcatttagtgtctggaaagagtgcattttgaaagaaagtgagatagtccattaatatgtttattaagagcaattcaggacgttgcatacctttcaaatcaagggttacaaccggtgagaatatatttttggcgaaccctttgagcggagtggcaaggaataattcgacagtcttccttatttctttcttctgaatataccaggcaagacaccagctttctcatctgaaacagggcctttcacgtcattggtttcagtattgctctcaggaagagatgctttggattcgttatcattctctccttgatttttcttagagccagtgactggaatctcgattgatctacccatgaatgcaaagcctgggtggaataccgttagaaccacagtggccaaagacatcatcaatgcgtcaaggataatgaagtaccactcgtgagaaattaagaaaccattccaaccttgggccaactcagcgactctgtaaatacaacgaacatacacgaacaataccgctgctgtaagagccaagttgaagtaatggaaagtccaacgatgaccttctctgaccattgcgtatttttctctgaacaagtgatcaacgtcgaaccttgacactttaaataattgaaaccacttccaatgcgatatacccaaatactcagctcttgtcttgatgtaaacttcgtacaagaaatggaaccataggcccaagaagatcgtcatcgatgccacctgcacggcaagaccagcaacgaaaatgttgtcaccggtatcggtacttttcagttctctaacggcagaagcagatgtaccaccaccgacagcctggatgacaagcgaaacaatatcacaaacgataaaaatgtacgaataagacatcggagttggtaacaaagcgtaacgctggccataaatttcgatcaattttgccaattggtaatagataccggccatagtgaaaactggagcaatggtcaaacaaacaatctgcataatgaaataatctgcctgcggaccaccatcttgatgagacaaagccctaccaacgtaaccgattgtttcaaggacgcatgcacatataaagcacacaaaaaaccaccattgcttggtaaatgcaccgataaaagcatgacaaaacactaaaacaccgaaaatagctgccatggtacaattaaaccttaaattaggcattgtaccagaataatagttaacatcatcaggattgatcgttgccgtgggcaacgctgaaacaacagcagtacctatgctggctatagtacttgacattgaaagtaaaaaaagtgattatcaattagctaatatctaattcctttcgataatgtgcccggctaaagtctaactgtaaatatataaacagaatgatatttgaagccaaataagagtctcactcgatagttggacttatctattgacagatagttgcgagagatcaaattttaccaacatctttactaataaaacttcggtgacacagctttcatgatatcatgtatattcgatgcttatatatatatatatttgaatcccaaatcaaaattcgcagaacaaagaaaaaggtataaaagaaatgagaatagaaacagttccatacggcctgcgaattgatgaatcaggatttcctacgcatctgtaagaaagaattcccctatgactgatgatgcgatgcacatttactaattcagcaccgcccccaattgtagcaagccattcatcctgttaaaaataaatactttcccaatacctacttgaataccgcgagtatgcggatatacattgcatctcatctacattcccggaaagtaagatacaagatattttaactaatgctctgctgccgtaagttgcaccattaagacgttaaaggaccatggcattgacattgtcaatgccactcaccattgacctactcttccaaacctaaccctgatgatagttttgagaataacagcatgctgtacattttctctttatctttcttccgatgagttgtatataccgtaaatacagcgaatgcacctgactgtaagattttcctttaatatttgcctagcattcctcgagtcattgcagctatttctgtggacaggggcgggggcgggggtcctcgtcatattattagctttcctaaggggaaaaaaaccagtttttcacgctatgcacttgttgttacccggacatcatgtaccgataggatcctatttttattctcggtgactcgggcttagctccaagcattggacaattaagaccggaatccagtacttcgctacccgctgatattaacacagtgcggtcacgtggatacgatttttgatgacgatgaagataacataacatagcataaaatttatatgcgatgcctgtgcaatgtgcctccttaattttgaaatttccagcccttattccttctgtgggctattatatccttgttagatcttggcaagggaacaaaataagtaatcgaacttatttgatccttgaacggcttatattagattttccaatcttttttttttctttgattttcgaactgtttttctatttactgtcggaattgcattttagaagttcaccttgatggatcacagcgttctggataaagcacccctgtgttcttttagctgtcctttattaatcatctcttggtctgtatatatactagatatatatacttggtacttctggtttttatcagctgcagaagtttaatcttctttgtcaactgtagagttgaacgtgaccgaatattcccctgatttatagttttggaggaataaggccaatcatggcagctaagatacctcatgttgattcgaattaccgtaatgactataccggtaagaagtatacgtttagatcgtggctatacgatgtagcggtgttcatcttcgatatagtattcacgatttttttcagagagattcaagtccgtggttcgtaccatgtccccacaaaaaataccccaacgatccttgtgtgtgcaccacatgcgaatcaattcattgacgcttgtttagtcatgtcgcagactaggaagattactggctctcgttcaaaacagacgtgctttgttaccgctgaaggttcgatgaagaacaatagatttgtgggattgtttggatcttggaccggtgcaattccggttcctagagttcaggataatctcgcacctgtggcctcacacttcaagctttatattccaaactatgattctgatccgactttggtcaaattgatgtcttttgaaggaccagtacgagctacttctcatttcactccgaaatcgttgatcggattgccaggttacattggtagcgctcaaattgaaacagttgtcgatgatgaaacgataaggttgaggaaaccgttccctgataacaaccgggtaaaaaactgtgtatcgaaaccaacatcgttcttatacgctgaaaagatcgataactcgaaagtgttcgaaaatgtgtttaaccatttgcacacaagaggctgtgtcggtatcttccccgaaggcggttctcacgatagaccttcgcttctaccattaaaggctggtgtcgctattatggcactaggtgctgcagcagctgatccaacgatggaagttcatgttgttccatgcggattgcattacttccacagaaacaaattcagatctagagctactttggaatacactgagccaattattgtcactggtgagatgggagctgcgtatttgaaggatcccagaggtgccacctcgagtcttctaaagagaattgaagaagccctttattccgtgacaatgaatgctgatgattacgatacccttatggctgtgcaaacggcgaggagattataccaactttcgaaaagatccactacgggttcaacgttaccattaagtgacaatgactctaatcatagaattccgttaccattggtagttgagatgaatagaagattgcttgttggttattcgaaatttaaaggtgaacctagaattcaacatctaaagaaggctattcaagattataacaggatgcttttcaagatgggtttgaaagaccaccaaatcatgaacttacacccaaaggatgaaaaatggattgtccttgtaacattgttaatcagatgcgtgcaagtttactttattgtcctaatgtctttccctggtgtcattttgttcagccccatcttcattacttgtaagtacttctccagaaagaaggcccttgaggggttgaaaaaatccaccgttaagattaaaggacaagatttgattgccacttggaagatcgtcgttgctatatcaatggctccaacactatacacaatatattcattgatcatggtttatatcacaaggaaacacccatctctctacaactggttaattgttccacattttatcttcaagagcaaactcttgtactttatctattgctatgtggtgttgattctcgccacgtatgtcagttttgttaccggagaaattgggatggatatagtcaaatcattcccacctttgttagtgtctttgctttatcccggtcatacttgtgagaaattaaagaaaaccaggatgaagcttagtcaagatattactgaggtgtgtaatgatttaggtccaatggttttcccagatttgaaggagaaaagagagctacggaaagaattcttcgaaaatgatggctcagaaatagaggataaagattcagatcgtgaagctgatgaagaaccaaacactagaagtcgttcatcttcggtctattcaaatgattctagtgtatctaatgcactttccaaaatcaattcaaggggttctttagttgatattcctatcttttctgatggtcctcattgttatcaaacagaagatcaagattttcctacaagctctgtcgacattgaaccgcttcaaccacattcaaaaattgcgtcactgatcaggcaacgcagagaaaaggaggaagattgatagagaattccggtcttcattattatattccacttcacatatagatatcttcaattaactaatgcataacgtttaaattagataacttaccacgttacatgaaagagtaaagattctaatacaattacttgaccaatgttgtatgcagagatcaatcctcccctgcaggcatctcatctttcaaaactttgtttagttttaccctaagttcagtctgtgtatttcctcttaacacatcagatacaaaatacacctcacagtccagttgtaccatttccagggcaccttttagaacaccacataatatattagaataccatagctccttcgacgcatccataggtaattcaacgaagtcggatagagggttttcatcgaatattagagaaaaagagttctttgtattggaccagttggtgacatgtggagttatatttagaaatattttgaatgcacacttactgatcacctcacttgtggtgacaaagttgtcgcatcttggaatggcagtacgagctaggaagtcttcgataagccttattccaatattgtagcccattgaaaacaattgatcgtttactttcttgaaatcacgctggtaatcttgacatagttgagaaactatggatccatacgttagagtaaatagctccgcgttgatcttaacagtacgattcttccatacggtttcaccaatttgttttatggtttttgaggatgccagacttgtcgtattagcagcagaggccgttttcgaagtgcccgtggtagtgttcatgattaatccggtttcttgattggaatgtgtgttttcctcactataagatagcccttccctgtgaaagcacccttcaattatactttaatcgattatgttcaatattataatgaatgttctttgatttcaactttttttatttcattgtaatactaaaagttgcagaatgtgatgagtacagtccttagacatacaaatatggctgaaagcatacagaatataggatgccagtgccgtaacacaaatcatagggtgttcatgttcacatatcgttatattataataatttaattcttgtttttctataaaactaaatatttccactatacattgaggggaaacttaatctttgttcaacaaattgtccaggataacttggtatttaccatgagttgccttgttagccttcagtaaaatttcctctgctctcttgtaagagtcttcctgttctttcgattcgtaatcgtaaaggttccctaaatcaatgatcgcttcagcgacgtcgacccaggtttgaggttcatcttccactttcgcttcttgcaagtacctgatagcatattcaaccaatggaatggctttcgattgtgcatttttagccttctctagagcctccttatcagtttgctcttcatcgtcgctatcatacatcaattcagcaaaagtttttgatggttcctcggccagttttaagtaaagttggccaagcgtacgcgcgatactcttgaacaaaactactgttggatgatctttatcgatgtcagggccgaccttgttgcaaaatgatgaagatatgtcattgaacaaattcaacaaattttctttcaaccactcgtagttctgattcatgtttttcttgattttcgttagtggatggttttcgtgcaatacaacctctactaattcctcaccttcatcatcgctatccaacccatcttccaattcctctttatcctcgaatgtctcaatgatgtctagcaagtcatagaaacttaacagcacatcatatgccaattgatgctgatttgacgaaagagtgtacgaactctttgccgattctaataaatcataaagcttgtacttctcgtcgttttgatccaatggagagagttgagatatatactgtaaggggattctttgtaaaataattttagtttgcgttaaagataacaaaggagtttccgggtatttctcagcgccaagtctatacctttccaaagcagcatcgaaaaattcattcattctctcgtacttcttctcttcgtcatcggtttcttccggaaggaaaactgttagctctgccaaagcctgcgcataaatagagtgaaacaaatcgctcagttttatagtgctatcattgtcctgaagacgcaataatctgtcacattcgtgcactacaccatttaacaatagctgattatctttatccttcaggaaagtttcccacaaaccctttagttggactaactcatcatcggcatcctcgttttcatccaatgcaatttcaatctggtttgctgcagatggtgctggtaccgttccctcagaagattgctcttctggcacagcaactttttgcttcttttgtttcttacttttgcctaatcccaaagctcttttagccatctttgcagttcttatctttgtttttagttgttctcgtagagcctttatcacgtgagatcttgtggtgaattgagtttagaaacaggaccgacttatacatcgcacttgccagcaatttatataactgcatgtatctctaatctcatctcgtaaaatgtgtcgttaaataaaattgaaccatgccacgctcaaatctgatgcttactggcacggcctgtcagctgattccatactgtattcgtgaaaggcgatttgaaaaagaaaatgtgaatctgagatctgaagtcacgtgtatgtatttatacacgtgacttggtgaaatgttgtttttttttttaattatcaagctccacatcacagttgtggcttcaagtcccttccgatgagttgcaatgatgcattcaggccatgtagtgtgagcaatttgaattatgtaggtttgaatagagtaaaacagtgtaaactaaggcgtcaatcactcattttaatactttcatgattcgagatcagttatagtatatatatatgtgtatgtatgtatcaaggttacagtatcagttaaggtaagtactagtttggaattcttgtaacttatttatcgatatgtccggtaaactaaatcatagaggcatacttctaccaatgtctgttcaaaatgaatccaggtttattgagaaacggtttacaccgttgattacaagtttgaaatcagtaggagagcagtatttgcttattggtacacactcaataaatgtaactcaatcaagaattagcagtatacttgactctggtgcatcatgcgtggtgattcatagtggtaagaattcagacctgaagcaattatctcagaggttttacggtaataatgatgtggttcttttagatagagagttccagttatccgatttgacaactctcggcagagttgctgtaggtaagatcgttgacagagtctttgtgaacttggactcaaaacagtctctgttgatcagagatatctttgagcaatgtcagaagttaagaataccgattaatactcatcagagaccagaatactctacgttctcgatatgttctacatacaatgatccaggacaaagcgggttgcagatcgctatcaccactaatgggcaaggttgtttactggcgaataggatcaaaagagaaattgtatcaaggctaccgcaaaacatttccaaagttgtaagtaatatgggacatctcagagaaagaataatatacgaggatcataatcaaattattcattcccatttcttaaacaaagatttacaagatttggggttcggaatcgacgaagatgtttgggagtctcataagttgaataaacttgtgtatgagttcaacgtaagtgagaaacagttgaaaatgaagcgtagtagatggttatcgcagattatggaatattatcctttgcaatcgttggctgaactttctgtggatcagttggccgatcagtaccacaaaatttctcaagaagataactctaaggagaatgcttccaaaaaacaacgtaacactccagataagaaggctagtaacgtaaatgatgccgatgtccaagtttcaaccactgcaagcagtatattggatgttcccaagaaaggatcgatttcactagtgggcagtggtccaggatctgtatccatgctcacgattggtgccttacatgagatcaaaactgctgatctcattcttgcagataagttggttcctgaaaaggtactacagttaataccacaaggtactgagaccttcatcgccagaaaattccctggtaatgcggaaagggcacaagaagaacttttagagaagggttttgacggtttgcagaaaggattgaaagtagtaagattaaaacagggagacccatatatatttggacgtggtggcgaagagttcctcttcttccaggacaaagggtacactccgttggtgcttccaggcttatcttccgctcttgcagctacagtcgtgtcaaatattcctgcaactcaacgtgacgtagcagatcaagtcttaatctgcacaggtacaggcagaaagggtgcattaccaaacatccccgaatatgtggaaacgaggactaccgttttcctcatgtcattgcacagggcacaagtgttgatcgatgcattgttggagaaaggatgggatgaaaacgttcctgcggccatagtagaaagagcctcttgtccagatcaacgtatcacaagaactttactgaaaaacataccacaaacagtagaggaaattggatcaagacccccaggtctattagttgtaggaaatgccatcaatgttctaaccgatccagaactattgaagtacgattcttcaaacacataccatattgaagaaggatacgaacacgttggattcgaggacaatgtacaaaaactattaaatatttaacattatttattcatagacagtcataacataatgcatatcataatatctattagtatcaagatggggttcctcaactcagtatgcgcttgatatttctgactgcactaaaatattgttgtgaaatactggaaatctggtataaaagaaaataagaaccttaaaaccagcgcaaaatcaattcattaaaagcacaagacctgaactaaaattgagctgaaccctgcatcaaagccgaccgtaaagcaaaaaaaaatgccgtcattcgctttcaaaagagcattgacaagagccttccacacagacattgcgtttgcatttgacatagatggtgttttactgagatccaagactccaattccaggtgcatctgaggctttaaaactgctaaacaaagaaaagatcccatatatactgctgaccaacggaggtggtgtgcttgagaacaaacgtaccgaacttatttcagacgcattggatgttgaaatctcaccgttacaaatcgtgcagagtcatactccatttaaggctctagttaataaacacaagaaagtactatgctctggggttgacactgtcagagacgtcgctgagaaatacggattcgagaaggtgattcaaccaattgacgtcctagcatataacaaggatatttctccttttacagctgtcactgaagaacatttgaaaagagtagccaaaagacacgaatcgttgttggaaactccattcgatgcgatcatggttttcagcgatccaaaagattgggccactgatatccaagttatatctgatttattgaacagtgatcgtgggtaccttggtacactgaggaaaggtagtagtgaagaaccatcaattccaatatatttctctaacgatgatttactatgggccaatcattatcatttgaacagatttggacaaggtgcatttaggctcatcatcaatagtttatattcaaagctgaatgatgagaaaaaattaaacgatactgtcattggtaaaccatctaagctgacctacgatttcgctaacaacgtgttggtagattggagacagaaattaatcgatgggaagacagattccacagaacagttattaccgcgattgggtgttccaccaaaaaattcgccatttgagaaagtgtacatggtgggcgacaatccagcaagtgatatcatcggagcgttcaattacggatgggagagctgcttagtaagaaccggtgtttttgctgatggtgacaaattaccttgcaaaccaacaatgattgtcgataacgtattggaagccgttaccaaatccatggaaaggcattgaacgcaacttattgagttagagcccatgaactatatggaatataattagacctagtatttgttgagacaatgaattaaaatatacatagtttgtaatagaaaacagagttcatatcatttgatgtaatgatgcaagtaagagtaaaaagtcacgatatatatatattagggtagaagccaatgaggctaaggcaaaagaaaaacgatgacaggtatgttccgcaagttgtcaattgaccagcacatcaaagtaaaatcatcagaatcctgtccatgatgaaactattgatgtgttctctcttgtactaaaaattatgatatactggaaccatttccgtttgataattagagtgcattttatgaaaagttcagtcggcttaactggtaagataaagtctatttgtagagccctgcttttagtttagagtccgtttttagaagtaaattctgacccacattagatgtgaatctttggtacaataggttgctccttgtgtaacttatcagcgtttctttgatgcatttgatccttacaggatttcaaaccctgacattggtgattctccaaaagtctatgtttcgaacagaaatgaccatcacagaagttgcaatcgccaataaacttcacagcactgctgctacacttctcaaagcaacacttatccttctttttcttcttcttaacatccttttttgccactctggattgtgtcgtcactttaatgccgccatttgccacaccactttcgtctgcatgttctgctctcatttcgctgttttcaccagtaaagttattgtttatcgtttctggcatctttagattgtatatatccttagtagacccaaccaaacagttgattacggaggttttggtcttattgcctctgttatgactaaaatacctttatcaaaaaagacgacctgtagcctttatctatgttgaaactgtctatttcctttttccttttttccttttctttatataatacctgaatgccatagtaatcacggaaaaaaagcatttcgagacttgctcattatagcaaatgggcaagtctcatgtgtcatcttgacctaggagtgcatcagtactgcacaagggaatattctgtgatctaaagatgcgaaatggttgaatttggggtatgtgggttgtatatacaatacagactatgtagtgtttttagttctccattttaatgtttcatgagagttcggctccttcacaaatcgtcggatatactgttcaagttaatagattggcctggtttgaatgcggggaggcctaggtatggacatccggaacatctgaaggcatctcctagagcacatgaaccacaacctcctacttttttaccctctatagtgaaatcgatttctgtcaattcttcttccgagaatttaatgacttgttgttgcttagctcttcttgactctatttcttgttcctccatctctttaagtccacatgaacaatccttacaggcttttcttcttctttgcttggatttaccgcactggatcattgtgattgtatcctcttcggtttctgctattaaatcgtcttcatcaattgagtctccggtctctggatcatcgaaatcatcaaagaacttggttttagagttgtttgcagaatcgtcactttcgagatcatcgtcatcgtcctctagatccgagtcagtaagcttgattgcggatacctttttagtcagtttcttaaatgtaggtaatttcttcaaactaaccgcaagtcctgccgagggtgacgatccaataggttgtgttttattcagcttcttgaaacttggtaaagcaacaggtgcactggctccattcttcatgtttccctttaatgatatgctcactggagcctttttctctctagattctttcacccaatagtactctgacccattattactaacaatttcaaacccattaattaaagcatccactttcaaagtatcacttaatccatatagtctacctgaaggtttcaacgtcttgtgaagcacaggtattagttttggtggaaactgaatggcttctggcttttcaggagtcacatagtatattacatcgtacttctcatcatctggagaaatagtaccatcatttagtttgttaatcaaatactgagcaactatagtagtctcagacaagattgaacccttctcaatagtttccaatagctccggctgttgcgttacagctggatggatcaaaaccaacgagtctctactcacagtcatactttctttgaccttcttttatctctgcttccagttagtataaggggaaatgagcaacagtgaacagctcaataataaaccggtattaaacagtactgtgaaataagactaagtagtgtattctcttgatattagttcagcacccatataaagaaaatcttaacttgtcctgctgtccgctctttatcatgaacataagaaaacagttactcatctttccaacttcttactcatagaaagatgattaagttcttccaaatatattccagatgtcaagcttcggatttcctgagtaatcaagagaaaaaaaaaaaaaagaaagtatatcatggcacgtgacttacgggccaaaagttagattagtaagacaactgctgggttgccggaaccggttaatacgatggacggtaccggaaggacctgtatgtctggtattagaatgttacaatggggtgatagttatgtatgcatttatgtatagcttttgtgtaccgttgtgattagaatcggaaggttggtgttgtgatgactatggcgggttatgcgtcggtggatggtggcgatgttacggtttcgtgtagactcttgacttcatcgatttcattcacttcatcatcttcctcttcgtcatcgtcgtcgtcgtcgtcatcgtcatcgtcatcatcatcatcatcatcatcgtcatcgtcgtcatcatcatcatccaagttcttcttatcagatcgatcttcttcatcgtcgtcatcttcgtcttcatcttcttcgccttcctcttggttttcgtcttctggataccctcctaacttcataaccaccttgtctacgatctcattaccatccatcattccaccaagtcctatatcaccgtatatcccaacaactttctctgatggtttgaatacggtaatccaaggcatttcttctttaatcatgttaaggtgtctcttcgtgatggaagagttataactgttgcttaccatggatggtgccaaaaatattgggaacagtggattccaagctcttattacacttgtcaacaaattatcacataggcccaaggcaatcttagataaggtgttagcagtaagaggagccactacgagaatgtctgcccaacgacggagttcaatgtgtaatacgggatccgttctttgcttccacgcgtcccactcatcttgatccaaccacacttggatatgtggaggaagttcaatcttggccgctgtggatatcgtattaccatcagttgactttgtttcttgccctatgggtacggtgttggatgggatatcggtagatgctaccgtaggttcttgagacaaaggagatgatactgatggagtttgagcaacctgcgtttgaccttgtgtgtgggactggcctgaaatcgaccccttcttcctgttaagtgttctatttgcgaagaattgagcagcagcttgtgttaaaatgacttgaatcgacaccctgtctctaccatatatttcttctaattttttaatcattgatttgatcttcaatactgataacgaaccggtagctccaaacaagatgtgtagtttcccgtcatcttgtggtaaccttggatctacgttcttggcagcttctctctttgggatatttggagccactatctgcgcgatttccacaggtggttctgaggctattacctgttcatcttcaggaattgttgtttcatttagtttgaaagtgggagctgcgttggtttgtgatccatttggcattggtgatatactgttggatctggatcttgatttgaaacttggagaatgtaattcatcattcacgacaaaatgaggatgttgttcttcttgaggtttagatgtctctgcttgagaaccaaggttgataccttcgactccttcttgaatagtggcttccagtggtgtcttaggctcggtctcggcaccaccggcggtttgttccaccgcagaagtcttgtgtacgttggcaggagctttcctaacccttaaatcctcctgtgatttactcaagggggactgaatcctttgttcaattgcagttcctgcagttggttgttttacagaagtggttaattccacaggcggaggcgaccctgctttatccgaaacaactggggacgctaccttgcttggattgttcaaactgttaagtaaggctgacgcttgttctgcagcggcttgctgtttgagtacggcatgcttagcatcagtgaaagtcacagttggaactcgtttcaaaccagatgctggagtattactcacaacagcaccagaagtcccactggcattcataatagatttagtaatactaacagaaggactggccggtttattgaccggagacgtagtctgagaagcagacgatccaacagcgctacctgtcgaattgagcatctctgaatttctttgttcgccaagattcacaaatctaggggacaccaaagagggctggctctccggagagtgaggagttattggactcatttgattcccaagttgtctgaatatcgatacaaatcaaccacgaaacgattaagcagtcgctaactaattaaaattggaagaacaggtgctggtcaccgaacgcttttgaaaactattgccagaaattagaaagaaaaatctctctgtatgggaaaacaaaaactgttcccgcttgaaatgaatgtgtatttccacaacaaataaccggtatttaaattagcaccttgatagagtagcgtaatgtgtaaataaaaacaaccactggtgtctgcgaaaaccttttatctcaactgagaatattctaatatatccctttctatggttttcatggacctaatctactgtcccatttatttttttttcggtatttttccttgtgtgcttttattctgattttttgcttatgggaaaattagtttgagaagctgtcaagtgtgtattatggaatttggaattacgtgatggtaaggaaatttctaattggaggggaaaaaccgcacatgtaccgattcttaaagcttttagaataagtactgcatctagtatcgctgtttatgtagtcctaatgtagggtcagaggtgtatatacgattctgtttactgtagtgtacctcacataaccaaaaaaaaaaaaaaaaattcactgcggttcctgtaaatgagtgtgagtagaagcattaaccgtactgcaatgcttcatctgtcgaaatgggtagttggtgttgatggttgttgtccaaatttataataaaagagaattagatagctttaaaagataaagaatttagttatcgagaggttctattttgtatagggtaaatctatctctttcttgtactgttggcgaaacgtcctctaccaacacgaacattgtggtgctttaaaccatcgatggcaaacggcgagatataattttctgcagatccgccaccgatccagttgtttaggatcttttcgttgtgtcttctagtccattcttcttgtttgacagccttctcgtactccttttgatcttctcttaggagttcaacatcttgagaatgttttgaatgtacaaaacctttgttgccaaatctcttctgtgcattctttgataggggacttggtaaggaataacgattacctctgttattccattggaagttagccttcaaatgaggcgtcacttttccggtcacagaatcaacggaaaccgcacatctcaatacggtgcctgaaccaccacaagacggacagaaatgctttgccttaccatcttttggcataggtagtagttggaaacaggcatgacatcttaacatatagttacgaagcttcttgattcttaaaccggacatgaagttcatcaagtttaaatttaattgtaacgaaacgttctgcactgcaaaatcaccagtcgctagagctacttggttttgaggcagctctaatgatgatgcagtgttgttttcggatacgacgccttctccgcctgtggtatcttcgccgctgtctttgataatggcttctgttaagttatctggggtgatccattcaccatcctcatcggataggaatccttcttcttcttcgtcattttttgcttccgttgcagtttcaacttcttcttcaccaggtacatcaggggaaacttcatccactagtattggctgttcctgctcctcattagctggttcttgtgattcagttggttggtgttcggctgtagtttcttgagattttgcggcagcttctctcttttctctctgtttcttacctcctcttctagttttcttcttattcttcttcacaggcgtttcggcggtgtcagattcagcagtaggatcctgcgtttgttcaattgtttcctttggccttgtttcttccttcgtttcatgtttcaacgcttcacctggtctttttcttagtctccaatctcctttattaagttcagtctctaattcatatgccaacgcgatgatatggatatcgttagcacttagtacagaataatcaccagttaacttggcaaaatcggacactcgcttgattgatgcagccgaaggatgtttcaccttcaacgttcctaaactttgccaaatctctaagttcttcctagacttggcatctttgatttcatgcaatacagttggagcagtgtaaaatgtttccgcatagttctggtaatgggtataagattgagtgatcaatggagttgcatcgagcactaaagctttgacatgcggatgttgttcagccatagtgtattagttttatctttattagaccgaccagagcaacactattagctatagatgtgaaatgattctgttatacgatagtatagataggtacagcttaattaactgttcaacagtgaattcgtaacttgtttagcacatctcatctcatcgcatctcatcgcatcttaaggcttcatttcttttaataaaattttcatgcatgcatttcataccacgtgacttcgccatatcataacgtagttcattaacagaatttagataaacatgaggaagattgacgtggtgaaaaaagtttcgtttgtttgtcctatacctacagttagccgtgtgcttggagttgtgctggtactcttccaaaacgccattcttcctattcctgtttatttaggttcctttaggatatgatctttttgtcagaagaaccttcaaagcacgatgaaataagaatttgaaagaaaaatgattcaaaccgctaaaagaagagagtccaagaagtattatataccactgtatttatctttccacaccaggtacggatttctaccaataatcatctgttgaagtaaaatatgccagttgaaaaagatttgaaagaagcttattctctattgtacgataaaattgaagtggaaaaggcattggaattgtacgacaaagtcctcaagcaggatccaaatagtttgaatgcgaatgtgtacaaatcagtatgtcttgaaaaattatactttagatcaagttcatggcataacgaagaaaccttacaagcttcttacgatttcttaaagaaggcattagacattgcagaaagaagaggagacagatcaaaaatagggtttgtgtattttaggttttgcatacactactataattgtaagaaatactgtctagctcaagaattcatgcagaaatgtgaatcatatggattcaaagatgacactttaccaatgtggaaacataacattgatactgcaatcaggaagcatgtcaagaaggatgtgatggatgagagggcgaaggctgtgaggtctcctgagacagacaaagcttcttcagacatgtctccttcggaggcacaaaaggacctaccaacactttctcaggaggataaattaaaaatggattggtatcaaagctctagcactgttacactctcgttgttcaccaaaaatctacctaactcaaaaagtgatgttaatgtcagcatcaaaggctctcatctaagcatttcatatcctataccagataagggatcagaatttcaatattctatcatgttgagtcacaacgttgacccgactgctattcaagtttctgtattcactaagaagctagaagttacactaggcaaagctgaacagtatcaatggaagagtctagaaaggaccgatggggacgtaactccgctgattacgaaaaacatcatcaattcagactcttctgccaaagaactttcatatccttcatcatctaaaaaggccattgattggtccaagatagatattgacagcgatgaacaagattcaaagaatcaatccgcagacgcctttttccaacagatatacaagggagctgatgaagatacgagacgagctatgatgaaatcatttattgaaagcaatggaacctcattgagtacaaattgggaagaagtgtcaaagggaaaagttgagccagcattgcccgaaggtgttgaaatgaagaaattatagttaatatttcagttaatattacacgtgttattggatatatcacggatggtcaatttctatataaaagtataaacaatttctgttgaaactagtagatataatacagtgttgtcatcgggttcagtcaaaaagcactactatcccaatctatgttctcatcatttgcattgttgagtttggctaattgagattgcttccattcaatgaaattatcgtcattcaaaaagctcgagtcaccgttattagtattattggctccgttattactgcacacatttaatttgagtttaccttcaggggatttaattattgaatacactgacccaagaggttcttttattgggctacttggcaattttgtagccatatatcttgcaccatttgcatcttttacgttcatattgtttcgttcaaaactgttcaatgaacaatctcctaactttgcgagaggttggtgtgtcttttcagttgatttcaggatattcaaaaggttgctcgaaattggtgctaattgtttcggttttactatactttttcgtttttccctacaattcaaagagccgatacgagtatctagcgttggtatacgtgaaagatcttttttgaccgatatgtgaggaggtggaagaagtacatttgtttttttggtactttctattgtgatcctgcttcgaggggtgaaaaccggctttgatatcttattcttgtccacagactttacaaggcgtgtagaaccagctacacgacttgcttttggagttttaggtactactttcttgatttcgtcttgtttaacagaaggcggtttcatatttattctgcttttaggatacttgctcaataactcagcttcctgctgtatcacaacatctaaaaagtactcgccgttgagaaggaaaggctttccaaacacgtcttgaaattgaagtaatttttcttttaggtcttggacaatggttggaaaatgccttgatatacgttttcttgttctttcttcctcaagtaggatcttgtgagagtttcttgcgagaagcctcgaagagtcttttgtactttcatctaatctgattttgtctttctgtaaagaatcaaaactctcaatcaatttccagataggctgatagatatccatctttttcttaagatcctcgatctgagattcacaatactccaaaagatgctcatcatcttctaacgattgtgattctttggacatattatcaaatgaagtaaggaattcctcttgttcttccatagtaaatgacattgctttgtagtattcttttatcttctcccaagactcttgtattagtttttttatcaacttcttcttcatctcttccagcttaagtaactcatttgctaaattttctaatgaacgcattgataaatcagaattattctctatgaatttctgttgttgttgttctggaactttcaatttcgtccataaaacttggcactttctcaaaagttcagttctttccttcaatcgattttgtcgttggtattcgcatttcttcaatgacttttgtaatgattcgatagcatgccacgtaatagtcggtttagcatcttctgaaatttcaatatgtagttcatttggaagttctgaacggatatcaatgcacaaatcgtcagcaatttgtaagaggttgttcaataattccttataagtttcaagccgtctattgtattcctcctggtagttttttattaaggtttccaatgtgtggatacaattagacgtaaggttagaaaagaatgactgataaaacaccgctttttcttcttcctggaagaatttgaacaacgactgcatatctcctttacaggttcgtattctggtattgaaatcatcgcacaaagctgcagttggaagagctaggttggcaggtagaatttgatcttccatatcggggactttatccatcaaatgtcgtagtttcatgacagtggataaatgatccataaacttaggtaaataagcgttcataacaaaaactttcacattattgagcgttttcaatttgttaagtagtgaggctgatgttctttgaggacttgaacagttgtcatctataattgcttgagcagatgtctccagtacactgtttctcataaacagatcgggtatcgtatatactcctttcggatcattgatggcattaagcatacactgtaggctatgttgaccaacctgatattcttttgtaagcatatctcgttccgcattagcctcatcgaagaacttcgaaatcgaatttgatagattgtggaaaatctgtttctccttccttgatatctctatattcgagtatccaacctctcgatatatcacatcaagttcactcaataggttttgtagttgtcgggatataagattaaagttttctttgtataagctgtcatttgtctcaatattcatctgaccttgctttagaggtgatcttaaagttttcaagttaaccggtgtcaatcttaaacagtcagtagggtctggtacttccgatacaggtgttgtttgcatcttgtcatcgatgtttgtggcgctggttatgatggataaagggcattcaacagagagttgttgaaggtaattctactactctgcttttgttcggttttccagttttgatcgatgttctatgtatttacattttgaccaaattgggaaattcaaaacattgaagaatctataagcttgaactaagtgacgctgacgtcgaagcttaccataatggaagatgttggcagataggcattgtggcagaggagcttgagaggggggaagaagattaatatctgagttagatatgattattccacgttttaaaaaaaattcaaggtagtttttgtgtcaaagttcatactagggttttgactgtttttagaactatcacttggtatatgtagctggcatgtcactttgcctggcatattcaaacaaacatcttgaatatttattttacttacatgtaaagaatggccatatgaatacctgccttctgtggatcacataaggttcttttcaaagcctacagtagcatttttgtaatatcgttttgacagaataaatagacaataacaatggcatttggattgtcagaagccgatcttaagaagctgactaggacatcctgcttgaactttcgacccactttgagccccaacttccagttaaaaaccaactttatcatatctttgcgaatttggcgaatcctgcgttcgcccaatggcacaaccacatataaggacaaagtcaagagctgttgaaacggatcataaactatgatcgggtaactaccaatgtaataggcggttaagtatcaagatgatacataaggattgtttctagttgaaacatcattaaccaatctgaattattatataaggaggcattagatctgaacaaggaccatcgacacagtcatgccagatcgccaggtacatcaacatacactactagatatatagctaataaacactatggattcatcagataccaaagatcttgaaacaacaacacgtgactggaaataccagtatcaccaacaagaacacgacaaccacccgagaagagcattttatgagaactcgtccttgttagctcagttggtagagcgttcggcttttaagcattgctcgcaaggaaccgaaatgtcaggggttcgagccccctatgaggagttcttattttttgtttttggctatagaaatatttacaagcatcacactaaagcggtattacgacagttatagcacaatgtcggatgcctctatttagtgagtctgtcttaacacctgtagtgagtattgatatttttgcatgccaatggtgatgtttctggtgctacttctttatatacaatgacaatgcaattcataaggaaaatcttaatcttgcacagtttttgaaggttttgacgagaagaagggattcgagtatttttgtttacatttatctacgaatctcgatcacaacagccacccaactgtgttgcacaatgtctacagaacttgattttgatactgaagaaccattgattgacactgtcaggccgctaactaatgctactattacagtgcgagtgataaaatctttcccatacagaaatgttaagaatatcatcttcactgattacgatctaaaaaacaagaccgcaaaggatctatatgaagattgtatgaaaaagattcagaccaccggcgccttcagaccattccgtaatgtggtatatgatgccatgaaaatatacacacatgctcacgggtcgaaaaccgttaatcttgttataaatttcgatcacgatgataattgggttatggacattaatgattcttcaaagaagcttgttgaatacggtgttaaaaatgaaactgagatctcggtcttcaatcaagaagaatacgtctctttcaaagcaaacccagaagagaaatggctatagagtcgcactgcataaaagttatcgtcaaatcgataatatttcaaatttaatgtaagcaaaaattcatatgacaaaataacagcaatatttcttatttctatgtagttatacatatgattgctcctttaaaaccgaaaaatgttagcgtcggtatgctattgttgtatttcctttagtccaatagatggttgatcaattcacaggcaaactcgacgttagcaactccatagggtgtcgcactatctaagcctttccgggccacaatcccatcatgagcatttagtgttttaatatatacaggtacccgtatccaagttaatttagttaaattttgataaattgtagctctactttcatcgaaaggaagtttcggaaactttgtatgtttccactcttttgaatgagaacgaatgaattgtttccatacgtcattcatttgcgcagaatcattagtgagggtgtgatataaactattattctcaatggaccaatccgatccttggtccttaccgctatcttgttcatcattaatagcatcacctattacatttctaatggatgacatgatagtattgaaaacaccattttctcccgattctagcttccaatgtccttttctcaagagagaatggtgatgataagtagtaatataactgtagcatgttccaatgacattgactgtgaacaccagtgggaagaaaaatgtcattaacgccataataagcaatattcttgagaaccgttcttttaatgtgacaatggtttcattttctttaattctgtcaactgctgggtccaaggaatccaaatcgagtactctaggttgaacagggtactctgaaacgtctataggtaagttgtgattgaaatggtatctgacgttattccctgtttcgataaatggatcactgtcagtaataaaagaagtataaaatgccactgttctatcgttcttaacattagcgaaacataccctatgatgaaatcttgataacccataaaggtactcaccctgagacaaatcaacaaggattctgtcatccttattactgatgaatatttcggccccactccttccaagaatcgtcctgccaagcccagataacacagaagtcagaatcttccgtgacacgtaacgtcttgtcttatcactgggcaggtaaaagttcacaccaagatgcggagtagcaaatgtcatgaagatcatcggttccatgtgttgaaaaatatccctgcattcggtgaccatcttaccgataataaaccgagataccaatccacccatagaataaccaatcatgctcactcgatcgaatttttcgggaccataattaaggacaaacttacatatctcatccaatacgttataactcaccactctgatgccatgcaacgtcttaaggtacccggagttttccggtttgaagatcacaatatcatcaatatcatccaaagtcttttccaacatctccttgatggagttcatatgtttatgatttccccataatccatgaacgagaataaacaagtgtttcttcttagtttctgtcatctcacaagatcttatcttaacactggtcggtgaatcagatctaatcttttcctttgacacttgatcgtgctaacagtgtgtctgatcgttcgtcaataataccttaaaaatagaatgttgaaaaaaaaaaaaggaggaatgtatgtatcagtgataatgatgttcctcgatcaaataattggcatccaatttgattctcgtcacttaaataagatgcatatatggctgcttttgccaccaagatcttactgttagttgttggagcctaggcatgtgcatctgtgtgcataagtaaacgatgtggcttgtctgttaactatattctggaaatatgtcagcaaaggaaataaaaaaaaactaaaaatccgttgcagcgatgaactgtgaacggttcaattaacgtaaatgcggtgaaaatttgtttacttttgtctatgtatatgcatgtacttcttgaaagtcaggtcttcgtaaacagtttcagtagtgtttctacacagtcttggatcgattcaaaactaatgggttcagtttctctgagttcgtctctgaaagcgaattcagacgccttgtacgtcatcttgtacaatttttcgtgttgagttcgatgaactcctcgtagcctgagtcctgaaagtatgcactgagacagcaacgacataaattgctgctgttgatcgttgagcaagacttgtttgttcaacgagttacttttcagtattcgctgacgtttgttcttctctagaatcgattcgatcgacatcgttgctccagcgttacttggcacaacagattgtagttcgtcggctgataacggtatcaatttcttatcaagttcgtgtttagtcgataagtgaagtaccatcgattcaatttcgaaagacgcgtttatatcggtcttcaaacgcttgtagaataggaaatattcgaattgctctttcgtcaacacttgggatcccgttactttacatacaattcctcgattcctgtgtcgttgtctcatcaacttcgctctgaaataattgacgctggtctcgctagtagtgaagcattggtaccgttgacctctattgagccaaaacggcagcttatcaatgttgaccattccaacaacttctgccagacaatttttcactgcaatttggccatcaccgtcctcaaattcacgccacaactggacgtctcttatcacagtgttatgacccacattaagcctcaagataagttctttttctagtgtcataggttcatcgcgcaactctccaggtccaattcccctaataccaggcctaccgaggtcttctttcacgtttgctactttcacttaacaatttgaaactgaccagacaatgtattcacctcctttatagtcttagtttccctgtatatgaaagtccgccgttgtattgtggttcacggtgcaaaagcttagcttatatccattgttaccatacgaatcttttttctctcgacgctttcacggctccaaacaaaatgctttcagttttcaacattgaaataaagtgaaggcaaagaaaaaaaatgttattgctcaacgtaattgaacaatagacagccagaagttggaagtggttagagactacagaggctagagagtaccgttttggatcacatcagactctaagttttgaaaacgggaaaagggaggtcatctcttttttttttttgatttccttctcatcatgtcgacgttacaaccttctgcgttgaataagaagagcaaacgagtttatagcgttgctagggtgtatcaggatgcttgtgagaaacgccctcaagagtactgggattatgaacaatgcgtgatgattgattggggtaagatttcgaactatgaagtgataaaaaagattggtcgtggtaaatacagtgaagttttcaaagggaaatctgtattgaacgatataccatgcgtcatcaaggttctcaagccagtgaagatgaagaaaatttatagagagttaaaagtgttaactaatttgacagggggacctaatataattggattattggatattgttcaagatccaggatccaaaatcccggcattgatctttgaagaggtgaaaaatgtcgacttccgtacgctttatccatcgtttacattatcggatacgcaattttatttcacacaattgttaactgctttagactattgtcattcgatgggtatcatgcatcgtgatgtgaagcctcaaaacgtcatgattgatcctaatgaacgtaagctaaggttgatcgattggggattagcagagttttaccatccgggagtggattataacatcagggtggcgtctcgttatcacaagggacctgaactcttggtgagcttaaaccaatacgattactctttagatttgtgggctgtcggatgtatgatagcagctattgttttcaagaaggagccatttttcaaaggaagcacgaatgcagatcaattggtgaaaattgccaaggtacttggtacgcaggagttattctattacttgaaacattacggattggatcttcctgcagaatacaacgatatcatgaagaactacgaacggaaaccatggagctatttcgccaatgataagacgccgttggctgtggacgaaataattgatttgatcgaccatttactacgttatgatcaccaagagagattaactgcaaaagaagccatggagcataaattcttcaaaaaagatttctcatagtgtatgcctaaacggtaatatatatctgttttctcatctctctatcatcaaattttcttttccctcttatcttccatttatggttaactttgggggattcttcttctgtctttgattgctttccaattaaaagcatgtatactaataacatataattaatacaacacctgaaaaagaggacagaaacacatgtctcttttgcttaagatttaaagaagatgtaatattatgatagtcgttaattcattaaaaaggatatataattaataggtgtaatagctaccaaacctgaaagaaaaggctcttactagcgcaggcgcagagagagagacactactataagtaggaaaggaaatagaccaaaggaatatgaaacagggtggaaatagttacaaaaacccatgatcgaaactattattgcggtgaaagttcagtgatgagaattgaaaatgccattattattagtctatatttctcaatcacagggaaaaaaacaatcttttggtatcaaatgcgtaaagatcccagacctttgacggatttcgtgtagtatgctgtgttagtggatgggattttttaagaggtcagatttcttgggcgagtcagattacagttccatttcgtaatcttcatcgttttcctcgtcactgtcgtggacatcaagaatgaagcaatcctgcctcataatcatttcgttggcccatgtatcgttgatggcactagttccatcataaatgacaccactatgatcgatctctcttgtgcgaacactatcatcgaaccttatgttcttattgttcgagtggtgggagggtggagaaccgaagccagaagaattagtctttaccaaaataggcttgctattttcaaagatggatgaagcatctgaattggttggggaagaagagtaattgttatacgattgagaataagactccaagtcggagtccatgtccatagcagagaacatagaatcgggtgacgatttcttcttaggaatcaactgagtagcagcaacacaatcatccgataactgaggcccatatagtacagtcatatcattttccttattccagttaatacgtaaaggatcgtacttgttttcattaccgttcaactggaagttctccatcgaccaacgcctccatagacaatggtgtagtcttttcaaatagtagttataatcagattcatcttcctgggaacaactaggcaacctgagcactttatgtttaccgactttcaataaaactttccaagtctcacagatagcataagtttcttggaaattgtgatggaaataatcgatagctggcttattcaaattcgtaacattatctagcagcaaaaggtttttccggataataatcgtatcgtccaaactattggatatcattgtaaaggatatgttagatgtgagtcgttactatcaccttgcagataagaaatatattagatggtagaagaagtaaatcaacaaacggattaattgaacaaagatacacttatggtgctcttatatataaaaaagccttcgacctttgaacaataactactatttcttttgtagtttgttcaaccgttatataatttacaaatcttttcagaaagaatataatattcagataaagagacaccaggaagcatggaaaactcgcaatatatgaatttcaagaacccggtatttaacacgccggtgcaccgtttcttgtggtcgaacaatttggaccggaaaggtgaacccactccgatttatctaaggtaccacagacaatagagctacaatactatatttccaagcgtgtcagcagtgtcaattcagagtcatccaactgagattccaaccagaccccggtacttttcccagtggttggttacctgaatctaaaagaaaaacaatatggagctttcactgtaattatttgcagaaaaagagaaaaacagccaaaagaggttgctcggaaaagtggttctcctttccgcagctagaatgtgcagtagaaaacggttatttttccaaagaatagtggggcgggaatccgaaaaaatcataaaattgttttttctttctatggttctcttagaatcacaaggggggacaagaagaaaaacatctacgagacctatgtattacccgggctgatgcccgggtgtgttttctttttcttcgcttattgcttttcctttcggaaagatctgtacggggcgacctgttgtttcgatggggagccagaaaagtttttccgactggttggagaaggagatttgacagaaataaaacagcttgagtatccagctctagcggaggtgcgcagtgggtgtcgtaggaagaagcgggaaaaacggcagtgttgtttttccgggattcgtctcgtaaggtttttccgaatggtgtgaggaacaacttgatggtgagactttttggagatctcagttcgtcacattacgtagtggtaataaatcgtgttgatctgcacacgtctctgtttttgttgttgtcgttagtgattgataacagttgaatgtagtttcactgtggttttcttcttttccgtgcatttttgtttaatacttgttggctccatcgttgtgtcatttgtttaccatttgaaaaagataggtgcctcccgccgtcatttcgtcaggaccaaaggcgaaccgataaatggggggtaaactgcgtttcagaggggaaaaacagaaaaaaaagaacaagtcacgtgggcggattctatatgcactgttaccccgtctttctgtgatttttgtatttttacctatggacgtatctaatgatagtactttctcctatttaaatcacctttcacgaactttctcgtctctcatctccaagcgatcttgaagaaaaaaatttttttcacatctcatcgcatcgaagcttggactatttaaaaaacatgaaaaaatcaagtgaaaaatttttaatagttcttcatctcatcatatgtaaagttgaaagtgtttaatggtatctactttgtttatttcccttccccatcgcaaaactctagaacggtaaccacagctctagctagttaatattaatacacaatgtctcacagaaagtacgaagctccacgtcacggtcatttaggtttcttgccaagaaagagagctgcctctgttagaggtagagttaagtctttcccaaaggacgaccaaactaagccagttgctttgacctctttcttgggttacaaggctggtatgtccactatcgttagagacttggacagaccaggttccaagttccacaagcgtgaagttgttgaagctgttaccgttgttgacaccccaccaatcgttgttgtcggtgttgttggttacgttgaaaccccaagaggtttgagatccttgaccaccgtctgggctgaacatttgtccgacgaagtcaagagaagattctacaagaactggtacaagtccaagaagaaggctttcaccaagtactctgctaagtacgctgaaaacggtgcccaagtcgacagagaattggccagaatcaagaagtacgcttctgttgttagagtcttggtccacacccaagtcagaaagactccattgtctcaaaagaaggctcatttggctgaaatccaattgaacggtggttctgtctctgacaaggttgactgggctaaggaacacttcgaaaagaccgttgccgttgactctgtcttcgaacaaaacgaaatgatcgatgtcgttgccgttaccaagggtcacggtttcgaaggtgttacccacagatggggtaccaagaagcttccaagaaagacccacagaggtttgagaaaggttgcttgtatcggtgcttggcatccagcccacgttatgtggtccgttgctagagctggtcaaagaggttaccaccacagaacctctattaaccacaaggtctacagagttggtaagggtgacgacgaagctaacgccgctaccgaattcgacagaaccaagaagaccatcaccccaatgggtggtttcgtccactacggtgctatcaacaatgatttcgttatcttgaagggttctatcccaggtaccagaaagagagttgttactttaagaaagtccttgtacaccaacacctccagaaaggccttggaagaagttaccttgaagtggatcgacactgcttctaagttcggtaagggtagattccaaaccccagctgaaaagcacgctttcttgggtactttgaagaaggacttataaactcctcaactctaatagagtcgaattgagtaaaaagctttgcatgctgtaattttatagactagttttggagtactcaagaaagtgtttacactttctttcactatcccatcggctggttcataatatttcctgttgttttgacaactatctttaaatatgaaaatattagcatttgaataaataataattacacgcgcttccttcttgcaagttatttttctggagaagcactgaagagcctccgcggtcttcatcaacgctttcttctcttgctctttttccgatgattggagtactgtttcctacacatgtcactacaaaaccatttctcattgggtttgggtgcggctgataatcctacacaggggtaatggaaccattcgatggcacaagattcattatcacaagcaaccatgggtccatacgacacatctctacagaaacagtacgtctctgtctctggcttgtgcgtcttatcatgattcacatgttcttgctgaatcagtttctgttccctttctgcctctgggtaccttgatttcatagtgatcttaatcttgatcggtttgtgatgaggcaaaggtttcaatttcggttgtttcttcaagtgactatcgtaccttgccttaatctgagagaatcgctccaattcttgtttttcaaaattgagccgtgaatgttcttgccgtactaactctaagagatgttgcgcttgtcgcagcatctcttctgaatgacatccatctctattagtatcacctatatccaatgattgtatagtccagagggtgcgaatcacatcgcatggtaaatggtccagtgtactgagaaacccgtacctaacatcttccattgttcttgagctgtttccttctagccgattaactaagaccagaatggtcaattctattctaggcgttagcatgtacttactctttcttgaatggcttttgccatatggatatgaatggaaagacgttttacgttttcccagaaggaaaacattcacgtgacaagtcccagtcacgtgaatgacattgatgtttttgggatatggagttctgaccaatcacatcgaagaacgtgccgtcttctcataaacctccgcacatatggatattttcccgtacttagtgacttttcgtcgggaatatcgcccttaacacgcatcctccagtgcgcttaggatagaaaaccttcagaaaaacatcgctttcgaaaaataaaaaaaaatactttaaacataatcaatcacaaacaattatcattggattggacagaaaacttagcagagaaatgctcacagacagcgaaagggaaaaaaaaaaacggcttgaaaattttgggaatcgattttttctctatgtaaaaagcgatataatgaaaaatatctacaaaaatatagtatataattcttttcaaactagagaaaactttttggaaacgatatacatagattatttatatatacgtttagttggttatagtattaaccagggatttagtttgcgctgatcgatcaatcaattcaacggatttgatttaatatttatttttgaaaagaacggaataaaagaagcctgcgtcttttaaatttttgtcctttacctaactgtctatttgttcgtctttctggtacagatattaagaaaagaataataatacattctcaggatattatccattgtctgtgtgatacgaatataaattcaagaatatcagctttgattcatacaaatagttgttagaatatcaaaattcgggacatttttatcttttagaagagaattcaattaataggaaactaaagtgatatcataataataaacgatgttcagatcattttctactgccgctaaacaggccgtaaaaggtacttatgttcaaagagccattgttggtggtgctgctgttgtcggtattggtgcttcaacaatgttgtatgctgattccttgactgctgacgctatgacagctgctgagcatggtttgcatgccccaggttacggttggtctcacaacggtccattggaaactttcgaccattcttctatcagacgtggttaccaagtttaccgtgaagtttgtgctgcatgccattctttggaccgtgttgcatggagaaccatggttggtgtttctcacactaacgccgaagtcagagccatggctgaagagttcgaatacgatgacgaaccagatgaccaaggtaacccaaagaagagacctggtaaattggctgattatgtcccaggtccatatccaaacgaacaagctgctagagccgctaaccaaggtgctctacctccagatttgtccttgatcgtcaaggccagacacggtggtccagattatatctttgctttgttaactggttacccagaagaaccaccagccggtgttgtcttgcctccaggtgccaactacaacccatacttcccaggtggttccattgcgatgggtagagtcttgttcgacgatttggtcgaatacgaagacggtaccccagccactacttctcaaatggctaaggatgttaccactttcttgcactggtgttctgaaccagaacacgatgaaagaaagagattgggtctaaaggctatgatcgtattgtcctctctatacttgttgtccgtctgggtcaagaagttcaagtgggcttctatcaagtctagaaagattgtcttcaacccaccaaagaaatgagtttttttgaatattaatgtcgaaacgaataaagactaattcatatcaactctttctattttattctctcaactctctacttctgtttctccccatttccggagaaacttgcaaggtctcttcttttttgctacttgattgatcagtatttgattgttggtaatcaaatgtgatcttaatcatttagatcagagatacatcaaatatattcatctttccacccatacatcccacaccgtctgacacataaaaaaggattctaacaaaacaaaatggcttgaccatcaaccatgcttaaaaacatcttataaagagggaaaaggaagctcgattatcaagaatgaaacggtgaggatttaaatgaaaactttttttacgaacaacccctctctttattctcatcttctgagaatatggtacttcgggggaacaaatagtgtttttttcttacgaattagaaagaattgaacctcctcctttgtacgtcataatactactttccatgaagaaattgtcttttcattttttcttctggaacatgcgatacgtttatttatttgggaacaatgatctatttttctcttgatctgttactcttcattttgttttcaactctatcctctctgttcgaattctttacccatagtcttttgcctgccttttttccttctctttttcatggctttttaactttgatcgtttgttctctctctcaacacttgtaataatgaaagagaaacaaatgtcctcgttgttgttaattttattatcctgtcatccacattttatttattacgaaatttccctaacttatcctaaacttaacttaacttaacttatcctgtcaattaaaaaaagaacacctcttttaaaaccataaaaaaagtatcaacaaaaattcatcatttatcttcatgtctttatgataataacttattatttgaattgtttacccccctgctttgctcactagctgaaggagaaatccattgaactggttcaaaagttcaacgcatccacttgtatttcttttgcttcatcatatttattatcactgatttgcctatctactgctcttgcattcccggtcctacacatcatgcgcgaattagatttctttctgtgctcattattcttctcaaatattcactttactttgtttacaatctttgtttggaatatgcttgggaatatcgaagctgagtagcaatagcacttcatggaattgtgcaagcaatgaaaaccaattggatttagattatcttcggttgtttcactcaaagttggaaagtgagctcaattatataggaactcttcaacatcttgaaatatagtttgaacatgtatttgtatatgatatcacgaatatatatacatatatatttataatataacatagtgtattacaacatctgaagctattaactacgaggttcgcatattattacgacctaacaccttcatactttgggtttaagacttcaaagttaacatttaggtaaatattaataaaccaaagtgaaatttgaattgaataaaaatattccaagtttgcaaaacggaaatgaatactcaccagaccctccaatcacttgtaacaatcagccttgtagttaatggcgttaccaattatcctatactgagggttcccacaacataaaggtatgcaatcgtcataattatcacgtgacagacttactagctcaggttggtccttctcgttcttgccgtttcgtgttattacccttttaggaaagctaatgaatttctgaatcttctttctcagtaaggaaaagactttaaataattgcggcatctgagtattaattttgcagttgaaaccactgttcacactgctggtacctctttctaataacttcaagtgaggttttcttaccgctttagaggtgtaattgaattggtacaagtgaggcatctccttttgttgtagtattaacttttcgagacacgttgcgacgtgtgggataaaatatcaagttgctgaagttccgttcaagtcatacttcttctttgcggttacattcgatcacatacaaagcactgagaagagctgacagtatttattttgacagagcatacacttattgtggtcatataaatacctctaaggattctttcagtaaaaagggaaaagttttccgcacacctagagtacagattcactattaaaagcgagctacaagatgtgtagcaaggacggttctacgaacagtaacgttacaacgccaaagaaacggggcagacctgctattctaaaacagtactctgaccctatgaagtccccaatggctcaaacatcgttacagatgcaaaaatctcaacaatctttcaataagccattgatgcgtatcggtcattctccgactaagttcaagactcctcaaaggaaaagaagaggtagcggtacagatatctctccaccacattctgctactggctctacaaaaaaagggagatatagaggtgttgtgatgaattctccttcttcggctggttcgaaatctatcagaccaaaatctaagagggatgacgaattttcactttcgaaaactgatgatgaggatgcagatttggatgatccaagtaattatgatggtcatgacactagatctcttaaccatccccctagttctgctccaggaactcctttagatcaggtgttttcatcaatttctaggcatcataatgttagaagttcgcctcctgttatgtttaattccgactcaccaattcaagcgaaacgtaaattagctgttgacatgaacgaaacctctcattggaatgaggacagtactgtgagtgagaagagatggaaatttatgttgaacgttggcaaaaatggtaaagcttgcattgaaacgaactccttgaaaactacagacaccatagaatcagattcccaagctgaaaagagtcttcaacccccaaaacatttgttggaaaccccagttaaagtggctgatgttgacgaaaacggtgtggctagattcgacaagaaaagagttatgggtttcttgagacagatgaaatcgaaaaataagacattggatgacaaaccactccctgaacaaacaaaaaggtttactatcccttcgtcaccagcgggtcctccaaattcaacgggtacaattgctgaaccattgacgccgaaatgctctcaattgatgcaatttagaactggtttcactccgaattttaacattgacgagttacttgtgagtccgaaacttcaagaatcattgaataaaaaccttttcaaatctcctaaccaatacgtatttaaagtactgtctggagatcccctgttgatcaacgatcatcaggagacagatattatgaatcctcctcatagccaagaagtgtcagatatattatcatttctaaattctccaaaacgaggaaccaatttgagtaccccaccatctcatttggtcaatttcagctcaccaagagcgaatagcagaacattcgcatccaatttgaacaatgtaaagctgcaattgcctgcactcagcacccccaaaactgattcacatcaaagtcaacaattgcagcatacattgcttccttcaactcctttattgaaattagctactactggaacgccatcacaattcacacctataatacaaaaacaaatgaatgatgaaagcaaattcccattgacgcactctgtgcaccccatcaatctacgaaaaagtcaagtaaagaagttggaatccaatgatgatgccagaatggcgttgaagaaattgatcaacggtaattagtctcaagcgttccatactctaaccgattatttcacttctcgaaaacagtccacgtttggactcaatttggcccatttcataaccatgactgccgcctgtctttcagattttatgattctttgtaacaatattatacggacttccatttcgaaactagatacttttttatatactaccattacattaattccacattggctcatcaaaattgaacaaccaagaaagccctatccaggagcttaagaccccgatggagcagtaaatggagtagatcattagtcccaaaaactcatatttgtcgagagcggcgtacttgtgtttgagcacatctaaggcctgcacaaataagaccattggtatcaaaagcaagtaataacaaattgctaatctatcaaagaaaaaaattcttcttacaccgcttctgttgaccttactcgtctgacccatagcatagaagtataaaatgcaccagatgaaagtgtacaagaattttagtaaaaagtcttgagattcgtaaagcaatgggaataaagacacatatcccgcagaggccaacaatgtgaatggtgtcaaaagccttctatcgaaaggaactaagaaggaaaatggaaagataactaacataatagccttttcatgaacatgccagccaaataagaaggagacaaacccacatagggtcaaagaacctacaaacctcttgaaggatggatcgaataaaactgggacgacagccaagatctgatagaatagagttaataagaaagttaacttgggggtaatttgaggaagaacaacgaaaaacacatcttgaaccaatccacgagtgcctgagttgtttgactcaatcctgacatgaatatcagcagcagtctttggcatagaagtcaagacgatgcttagaatcttttgcaaatatggtagtttcaaaactaaaacggtaagaactttatcagtgaaagagtacaccgcccaaacatttggtgcccaataagcatgtgtgagacctctagagaagggaaataatctcgctaataattgttgccatgttgtaataaagggcaaaaaagccaacgaaaatatacccatgacaactgatgccaatttaagtaaattcgaccactgtacaattgatataagatctttgtaggacctaaatttgaaactgctgaaatcaagcacgtatgctctaagtaaaaagacaaaataagctggggcaagatacaaaaagatgtgcttgaaacataatgcaatggaaaagaacgccgcacatagtatatatctcttatttttggctgccacaattgaagatattaatattccgaaaaggaaaccattgtactggaagtgtatatggtctactatcaaaagtcctggagacaaaacaatactactggccacaacaaagttggcactcttctctgaaatatcactagtgttgatgaaaacttgaagggcggcataaagcaccaattcactcaatataactgtaattctttgaaatataatagttggcaaaccgaagctgccgacttttactatatccaaacacccatcttctgccactgattttggaacaaattgagaaaggaaccattcaaaatatgcaaaaaatgggggataatcaagagtccattgactagtagattccacataccatttattcagtgggagtttgttagtgatggccaaccaatttctatgtacgtcaaaatctgtgctataataacctgggaatagtaacactttcaacaccgtagcacatatccagaaattccaaagcgaataacgtcttgtcttcacgttattgatagcattaggtgcagaatttcgtttaccttgactaacctttgcatcagactttgccatcgtggcaattgtgctctcgggtctaccggtttattctcttttgttccagtcttatggtgatgtatatgtctgtataataacaacagcgattttaagtaaatattatttttgaccagattcaggtaagaaccaaggttctcctttagttatcaacattcaacaaaggcaacaaaagccaaatcagaaagcaacacgccatggagtttgataatgatcttggcaggtcagtctgggatgataacccagaagaaaacccattcaatgagttaagtagaacgtttgcaaacctgggcaaaccggctgatcaagagcaaccatttgaagaggaacatgaaccggaagaaaatgaatcgacaggcgatggcgtcaatgatgtgggcatcaccgataagaacggatggcatgcttctagctatcagacaccggtgagaagcagcgtttctaatgatgaatctcccttgaattctggtcctctatccgctagcgaaccaattcttgagagacacactgacaaattagaattgcttggttctttagcccctgaagaagatccattacatgagcttacacaaacggctactcttcagtccccaaagaaaagtgatcctttatttagtgggttagaaaaatcgccattgcacatctttgatgataattccacaggccatatcagttcacaacatcagcctcaaatgaaaacaaagtctgggaaactaaacaagcttttctcgagcgcaaggactcgcaggcatcctattaaaccaacacaagagaaagcttcgatttctattcatgacccactagtagaaagcctagtcgagaaagagaaaaatgaacagtttgttgaggagtcattggctgatgacaaagacgaaggtaagctgtcattggaacgtgaaatggattcacctctatatttaattgctgagagaaaggtaccatcctacattccgaaaacgaatagcacaatgtctagcagtaacacacaagagacaattgagaaattccagatttcggtcgttgatccaatgaaaattggagacattacgtctgtctacgtggagtataccgtcataagcaagtctaatttactagagggcaaaccaactagagttaaaagacgttatagagactttagatggctttacaggcaactacaacacaaccattggggtaaaataatacccccacctcctgaaaaacaagcggttggtagatttaaacaagattttattgaaaatagaagggctcagatggaacgaatgctccaacatatcgctagtaatcatgtgcttcagaaggatgaagactttatactattcttgacttcagagaaatggagccaagagtccaaagtaagagagcagatttcaggttcaaaggcctctcatgatagtaatgatatttctgatattcatatctctgaattgaaactccttggttctgaggatgcagaaagagtcttgaagaatggtggattagatacagagactggaggaagttttatgggactatcctttgcaactgctccaaaatataaggagcctgaccaattctttgtagatgctgctgaaaaaatggatatattagaggagcaattgaagcagttgtacaaagctttggaactggtcgattctcaaagatcagatttgtgttcggtaattaatgagtttagtgaaactttgaaagcactggctgatttggaattatcgaatcgaacatcagatctacttcaaaactttgcggaagtccaccttcgtataaaagagtctacttccaggagctcaatgcaggattcgctaacacttggcataactatcgatgataatctcagggcaataggtagtgtgaaagccgtgctaaatcaaaggaaaaaactcggttactatattctgcttgttgaaaacgacctgaataagaagcaaacccaattcaacaaagtgtcaggaaactctgccaatagtgaaaaggccacctcaattgaaaacgaacttcgcatcctcacatcccgatgcaataaaataaaacaggaatggcagacaatcgctgaagttataagaaaagatgttaaccaacatgacgtcgatacaattgaagattttaggaataacatggaaatataccttgagtcagccattgaaagtcaaaaagagtgcattgaaatttgggaaacgttctaccagaataatctataaattatgaataatggtttactgtcatttgtattatatatttcctaaacccttaacgtcttcttttttggcatcattttcttcttcgacaaagatgctgccaagtagatctattttgtcttgttgtttacctagctcgttgaatgaaacgatcatcccatcaaaggcaaaacataattctctggcgttcaacttgatactacggttggtattcgggacctttgggtatctttgtgagaaatgcgttagcaagagttttcttgcattcatcgtgtttgaaacttttatagcctcattaatggtactatgtctttttttcatagcttcaacttttaattcattttccaaggttgcctcatgaatcaatagatcggagtttttacctattcctcttgcgaactgattgaagttcggtcttgtatcaccagagtatgaaagtttgaagagctctttacttcttgcactcaggaagaaagaaatggaattacaatatgcccaatcgcagtgtattgccggacatgttctaaatgacattaagcgtaagttttgcatcaactttttgatctttgcggtatctttgacagcactttcttcgtcatgttccaaatcctttcttccttttgtagcataagttccatcgacatccatggataatggctttgtttgctttctgatatcgtctcctgcttttagatgttcgcagcttatgtactctatccttgaaagtatagctggatcttctagactaaaccattctcgaacaaatatgttatactgccatggcgtaataacgtaaagtttatcggcagtgtgcttgttgtgtttataccattctttaatgagacttgctatacccaaatggtgatcagcatggagatgacttagatatatcaactttacatctctgaaaagcttcggtacatcaatatcaggtatggtacggtgaatggtacccaaagtattttcccctgcatcgagaaggatagaacggttcacaacagtgccatcgacttcagtatacggtatcttcactaatgttgaaataacattacggtacttagatggcaatgcactaccagttccaagggaaattatttcaatttcattcaatttagttttattatcaaagttattgacgtgtacttgttcatgtacggtgcgttctaaagacgaaccttcaatgcataatggaaccacatgagactcatacaattcatcaatcgttgagctctgcttggctgtgggcaactgagattcatgtatgaccatattttctttaccaacagtgaaaggttccaaggctattcctttcatcttctcaaagacatgcatattctcgtttttcaccaaacatgatggcacatgttcttgttgttgaactaatgatgatccttctggtaggtcttttgggaagcagtggaaaaactcccgggagtaaactctatcggtaatgggaatgttataactttctacttgcaatgctttcaactttaaagttgcaattgctgcgctttcgtatgctatggtgtttggagaaattgaggaatgagatacataatgctggatttgatcatcgctgaacgtatcaaaaaattggaataaatcatcggtgatggtaacctcatcgccaaggaagtagtagatagctgacaattgatccgtaggataatttttaaattcatcaatgaatcgaggaatgtatttgtttgatggaatatccaagaccaaaactttcccaaagttcctagtttcactcaacacctgatcggagttgattacagtgccatcttctaaagtgatactattacccttagccaactcggcataaagtctacctttaggtacccccaatcttttagcttcttccacgttgaacttacctctaacagctgggaaggtaagctcgtaagacgtcgtcagattcttggctccaatggcttcaggcggtatatcaacatttaacgtgctatttgcagaaggatcctgttcatctgtgggatttacttcagggaacatacgagcgatgatattcttcaagccattagtaaaaccgagcgactgatgttgttgtacacattgatctacatttgcactattgctaatgacgattgattttacagtaatagtagagtcctgataacattccgaatttttcaacgtggaaacctttaaatccaaaccgaacctgaacacaaaatatctccaagtactaaccacgtaatccaagatattagatccataaaaaatgcttatatcttttttcccctgatcactagcagtcaagattaaccctggtaacccaccgatgcaggaataatccatctcacctgttaaaaatattccgttcaatttcccgaacttaacctttgactcattacaggctctttgagaaccttctcctatcttaccgaagaagtatttatcaccatgatcagactgaagcagtagcaatggctgcttagtatccaaacagggatgtgtaattggaatcaactggtacattgtatttaatctttgttgggatggtctggatgatctcttcttgactgaggattcaagaaaccgtctggtcactagtgcactggtagaaaaactcaagtaacgcaacttgggaaacaatatgaaaccgcagggttctaaaaggatccaatgaagtaaaaaaaatataaacagcagaagcagatgctgtagggccagtaaactcaaacctagcctaatagtattctgttgatgcgaagtttacggtgtgaaagaaactcaggaaaaaaaaaagtatacggatatccggtcgctataaacaccaacaggttgaataataacacccttttatcccagtgatgatatctcatatttcacctcatgtcatgtcatctcatcgcatcactacttctcactttaaacaacttcactacaaaaaataatacatggaactgaattagatttttcataaaaacagacaatttctgttgatgaatctgatatttccagtcacgtgttgttaaattaaaatctttggtatctggtgaatccatagtgtttattagctatatatctagtaatgtatgttgatgcacctggtgatctgtcatgactgtgttgatcgtctttgtccagatctaatacctccttatataataactcagattggttaatgatgtttcaactagaaacaatccttatgtatcatcttgatacttaaccgcctattacattggtagttacccgatcatagtttatgatccgtttcaataattctgctttgataaaggatttcaaccttggcaaaaccaactatagaacgcgctagtggtttagtggtaaaatctcagtttcccatactgaggccccgggttcgattcccggctggcgcattttcttcttcctttttgttatctattacataaagcacatctcttataccacaatacaaattctggaaccatactatgcaattacaagccatgttaccttttttttgtcttcctataacttcaaacgaattagtggtttctctattatgcacccttgtttccccatacagaagaaccctttatcttatcagccgtttcacttttcccttatcggagatcttacttccacaatggtttgtttaaagtttccatagaatatcactgaagcctgctgaaaatgacgaaatgtgaaaaaaattcctgggccgcatatataaaagggtgatacttttgcatttgaaggaagcaactcttccatcaacttacccctttattatccgatacatgtgtaccgaacaattgtgaaccagctctatcaagggtgtaattgggtgcgtgtgctatagacttattatacttttaggttacttgcttacggcaatttgttattgcattcttgacataataaacttttaatttaaaagttatagaagtaaaaatagtccatatacttctctgcgacatcttagacctacagctcgtatatttattagtatctgttggaaactaagaaacgaaatgccacaagctgatgggtctctcgagaataaaggtgcaaagattcatttagttgttttggtccatggattgtggggtaaccggtctcatatgaatgagatatgtaactatttgttatcgttgaatgattccagcgctggccacaaatctcttaatgagatgatagttgttcatcaaactcatctgaacgagggttataagacttacgacggaatcgatgtttgtggtataagagtctctaaagagatcaaggatcagattaaccattacggaagcgatcatgtagtgaaattttcgttaattgggtattctctaggtgggttaatctgtagatatgcgttgggtgttttgtaccaggcgcagacgttcaagaagaacgatatagagcttgtcaatttcatcactttttgcacccctcatgttggggtcttagctcccggtaataacgtagcagtgaacctatttaacattatcgttccattagtgttggggaatagtgggaaacagatgttcttaaaagataaatataatggttatcctttgttatacgtgatgagttcaccaagttcggtattttataaagcgctgaaacaattcaaatacagagccttatatgcaaatattattaacgacaagagaaccgcgtggtggacttcgggtatctcaaaaaatgacccattcttcgatgtcaatgaaaggaacggccttggaaggttccaatttgttcaaggatatgagcccgtgatcttgaatcataactcacctttgttcatcgcacctgttgccgatgaaatggattcatcttatgacgaattggaagagttacgaaaggaaaacgaaatagatccacaggactattatttcttgaattactggttcagtaagatgttacggtggattgctgtctttattaacttaatcatcattaccccactttggtttatctggtttatcatatctggtataatggaaacttgtaaatctaccgttagggccactacatttgcaaggaaatattccatgtattttataaccgaagtgcttgatatttcaaccgacaggactgagtccaacgacgatacgttttccatatcatcacccactttgtttgagccagccgaaagtaactacgaacttcgaatcgaacactctttgaccgatcagagagataatttaattgaaagtttgttcgacgcaattgaaaggaaagaaacgcgaactgcaacggtagaaaacatcaacgataaggatagcatctatgaacatgatccgaaagtagacgtgacaataagggagttggaacagtattcagtagaagagctcatctcgatgaaaaaaccaaacgtttccagtgataatttcaacgatgagggcgagctgttcaaattgctttcaaactttagcttgaacatcagcaagaaccaattggatattatcgaatccttgaataaactctcttggtccaaattccctatctatattcgcaaaacaccaagcacacacgctgcatcgattatcagacatgctgaccctaattttgtcgagggtcatatagttttgcaacatttcgtggacaatgtatttcaacttgcataatagtgataatcactggctttgatagataaatgaaaaaaaaaaacactaatccaactgtaacgtatctaacttgtgtctaatttgatttatccagtcatcattgaaaggatttatcacacttttcaaataatataatttgactttctggaagaagggtacgatagcatcatcctcgcgcatattgaaaccaattacaatcttcagacccttttggcccaaatattccccatagacaacgatctcgtgcatttcaaacaagtagaacggtggggcgtccatgttaccttttgttgtctcgccgaaatagtctaatgccaaatttgataagacattgtatttgatctcaagctgagatgattctgtatccattgcatgcacaagtaaaggtctatcatttttgtctaagagagatacgaatagcgttttcagcatcttatctgccgtcgaggttgtcatatctgtcaagttgtatctccccggtaaactagcgtccactttacttattattcttttgtcctagtatctttctgtgaagtgaagctagcattattatacttcattttcagatctttcatcgttcagttctttagccatttcattaaaattcatacatgcacatacatacatacatatatttgatacagaggaagatatacaacgtatcatagtaagttctggttatctataaaccacgggtagttgttgaagatctccttcattgcgagactcattttctgcagtcgccaaacattcacaaactagccttaattgatctagcagcctgtctgccaaatacgacacattctaacaaggaggaaccacctaatctgttggcaccgtgaacgccaccggaaacttcaccggcggcgtaaattccagtagcaatcggattaccttcagcatttagcacacgagactgttcgtcaatctttgcaccacccatggtgaaatgaactactggagtgattttgcccacgaaaatggtagaatcctccgaaagagtggatgcaaattgattttccctatgagtacgaccaaattggtcttcctttgaaatgtccgaataagtgaccaattcagagatcaaggtattggcatcaattggcaaatctttggcaaaatctgcaacagttgtttttgttactaatttcttgaacatgtagaagtcaagatttggcttataatttccatatagatcctcactcatgaccatccaggcagtttgtgatttgcatttggattgaatagctgcagtaacagtgtcacgagtgtttagttcattggtaaacctcaaacctgtgtcagggttcaataagataccacccaaacctcttaaagcttcagcagccaagaatttccagttggactcagggtcattaggatcgacaaagcctgttggatgaacctgaatttggtccatatcaattaatttagcacctagcctttctagtaaaacctgcccttcacccaaagtctgatcaccgtttgtggttggtaaatcgactagatgtggggcatatttttccaacaacttcttgttgaaaccaaatccacctgtacagaacacgacattgtttgtttcaatggaatgtgttccttctgaatcctcgtagactacaccatttaccttattattctcatcaagtttgacatcaattaccttgctattcaattggatcttgacgagatctgcgccatacgattgtaacgattttttcaaagtgtctacaatctggaaaccgggtggcagtttcccgctagatctatgggttcttgaaaccgaatgaccacccaattgggcaagtttatccaacggaatctgatgctcagtttgtagccaagaaatagcattcgctgaatctttggccaacttctccatcaatgtcacaatacctttccctctagcagatttgatcgtatcatctgcaaataactccggattatcaattatcttaagtttttcttgagtgtcggtaccagcaccattaataccgcttgacgccttgatcgaattaccaccaatgcttcctgtcttttccaataaaactattggaatattaaacttcactagttgggtagaggtcgttaatccagctaatcctgatcctataactacaacgggtttagacatggttgcttgattctttgaaaacaacgagtagaccaaatatacaacaacaaaaagtaaaagtattttaaggtatcgttgtcgcatttaaaaatataccctgcttatcatcgctgatcaaatgtgaacggactcatgctgaaatctcgctgataccactttttatacttcagaacccttttttttttcctaacaggtgaaaatggcagacaacagctgatccaagaaaaaagaacgataccactgaacggctgaaacgacaaaacgttccattgctccctatgcatgtctcagagattccagtatttcatgatgatgacacatgaaatgacacccgagttcacattttctgaatgtaaaatatatttcagttgaagtgaagtctatatatttggatatactttacaaaggagtttacgctgtgtagaaaccattagtgttcgactcatttaagtcaataactgtggtcgatggcgacttaaagccgtatgtagtcaatctcccaaacattagaaagagcaaagttgaatgaggagaaagtgaggcattgaaaatgtgcctttttgagctttttcgaatgaaaactatgcgagtcgtttgcaaaacgtatctgcacatattctataacttcattcgaacaaagcgatacttgcttttcgtattgtcaccaacctcatatatagagccaacttcttcgaagtataagtgaggtaagagagaaataatgaaaccaaacgaaccaaacatatcagtcgattccaaggatgctgatctcattgcttctgaattacaaaaacagaatgctagagtgttgtacatctctgaaaccacctttgtccctctgcaatagggtagtccaagcgctgcttgtaccaatggtcctcaaatgtatatgttagatagattaatatctgtgaatcattccatttgaataataaaatacgataacaaccataggaagttagatcataagagaaaaatatggatttttaaacggaatccaagactcgctagtgacccagccatgtaggaagtacaaaacgatgacattgtactgatcaatagcacgtgtagtcttggatgttgaaccaccgacttgaaatacacaaagtatttcaaaagtgctctttcttgtcaagaaacgaatgagacagcaaaggtgccacattcgcatggtgatgttgtcagaatagttcaacctcattggagaatgcaattccaatagtaaagtaacgcttattttcttcaataagagaagaaagtattactgtttgtccgtgtatccaattagcatacgtcctttattgaaaaaagaggcatcttctcaagaatttctcagtgaaatcacgagcagccgcttcaggacatttgtctacccttcatatggtagaagaaacatttaaatttaatccgataatgccaataatgtgtgtaattaatagtgcgtgtaacaattaaaagaatgatatgcaaaccataacgcgtgaaagccagtaagtacaatcagtacttgtaagtcttgatatcactgatagggttaccatggatatcaaaatcagtagattcactacggtagatttttgttggaccgttagtgtcgaatgggttttcctttgcgtattggaaagtttccaagacagcagacttaacattttccaaagtttctctggtgacttggtagtggaaagaaactctaccacccatcaatttgaccccatatttcaaacctttcttgacaagaacgtctgggttcatctttgccttttgcaagtccaagaagacgaagttggtgtcagctggagactccaatggaataccgttatctttacagaatttagccaattcgtgggccaactggtgagagtatcccatcttagtcttccagtcaccgttcacagcgcaaagtgccattctgcacataatacctgattgtctaacaccaccaccttgttgttttctgaaatggttacatttcttgacaaacttgttgctaccaacaagaacagaccccattggagcacccatggacttagatagacaaatggagatagagtcgaaaatttcaccgtactgtttcaaagagacaccggattcgacaactgcgttccaaattctagcaccgtcacagtgtaatttgatatcgttttccaaacaccaccctttgatacggatcaattcttccaatgggtaaacgataccgtgcaaagtgttttccaacgataacactcttgttggcgcaccgtgaatatccccgtcgtccgggatgtaatgagccttgatatcttccaaagtcatataatcaccgttagatgggatcaccggagtgaccatcgcttgagacaagattgccaacccagctgcttcatgagtataaacatgagctctgtaatcacacaagatagagtatggaggttggaatagatgcgttctcaaaccaatttggttcgataaagtaccagagacacagaataacccggcttctttaccagctaaacgagctacgacggtttctagctcaatggtgtcgacgtcttcgttatagactgcatcaccgatggaagcattgaaagcagcttccaacatttccttagttggagtggtgaaagtatcagaccgaaggtcattggcagctgaggtgtaagctggctctgaaggagcagcagcagtagatttcttatcagaagcagtcatttatgttgaattgatgtgatttagttttattggaggggttgaacctaaaataaaatggaactggtaatgttgttgtggattcacttaagtcaataaagtatattatatataaacaaagtgactaaatacaaaatataacccgttaggtttgatcctttgctatatatgatttttatatactgctctcaccatttataatcaaacaatatttatcactcaaactgccgatgagtaactcgacctgaaatatttcactgcttcaactttttccagcattgaggcaacaaacagaaaaaacaaaaaaaggaagaagagcaagagccagtagccaaaaacccttggccgggttaaccgagcagaatgccctagagcagtttacactggtagtggtgggaaatgcttattgaaaaattgtcaagaaaccattggctactttcattcacttcagcaactgaaaagtcaataagaaagaaaaaaaagcctcttgcctggctccagcctaactcagagaattccctctaggttataaggtttagacaggtgcatttttccatttctgtcgctaatccttgccgagagagaaacctggcgaaaatttcctacggtcccagtctcgccctagcagtgacttataggcggttcctgtgcagtgtcatgtttttcagggtacataaggtggtgcgtaacagccgggtaagagatgaaaaagaaaggaaaagtgaccaagtgagcatatgttgtttcttttgtctttgtcctttgatttctttttctctattctatgaaggtgaaagagcatgtggctgaataagtgagtaagttagttaaggttcgcgtacggtaatttcctaaataggaaattaccgtcgtgggcagccagcccacgcttcccgtccaccggtggggcggaaacggaattgccgccgcattcggcggacaggaagtgagtcacgtgggtcgcttttctctatctcgcttagttctgaatcacgtgacctgaagactggaatacccttttcttgataatatctatcatattagaacagagattaaaacagacatcagaactaagatcagttaaagatcgatgttgaaaccgcaattgttcgttagtacaatagtttagttgcgagttgacgtgatagaaattatattcgcttgccatggacggaatggataggattgaattcttgaagcatgttgctgctcagaacgacacaacaggactacgattcaaacaaccgacatggcacaagcatctgaagcgtaacaagaatgcgagacagttgatttcagacgaatggaaacgtcttacaaatacaaaggaaaaacaggatggagaacctgaagacccagaccaaaatagaaccagattatcatactttaacgtacaggcatatccgtctactaaacctgcaaagaagtactgtgatgtgacaggcctgaaggctcactataaagctccgaataccgggttaaggttccacaacagcgaggtatattcgctgataatcaaacctatggcaccgggcgcagaacaagcgtacttgaagctaagaggtgatcatttcgtgttgaaatgatctaggcctttgaagttgtgtaaaccatagtttattagttatataggatagtcaattaatggatattcattcggaaaaatctacgaaatgtagaagcgacataattccattctacttctagtatacctcttgcgatgacaaacggtagcattttccggtagagtgcttcttccttctaggttttggtgttgatgtttttttatagtttcaacatcggaaagtttacaaaatgttctgggaactaaaattaatcatttggtgaatcaatgaaaacatcatcggtaaaattataaaagtacatatttaataaaggcgcaaagacgccatcccgagactggaacactcagaactgtaaacatccagcttgcatatttggcagctatgatcacttatgctgcttgcacgttgtttgccgcagtttgattatggtatagacttttccagtttttacatattccggtgttcaagattgttggcttgttgaatatcgaattaccacaatcgaccaaagtatctgtggataagattactcaagaaactataactctacattgggagaatgagcctgattgtatctattcatcaacagggctagacgaatcgcatcacagattcaaagtactatcgtataaactttacttgaacgggaagctagttggtaattttccaaatacgaagagaacttacacatgtgtttcgttacagggtttgaagccagggcagcagtaccaaatagatctggtcaccgttaaccaattgggtttcactaataagctacctaatgtgtttgtcatgacgttgcctgttaatactaaacttaccacagatgcttctatgtcgccagacttcccagaagaagctcaagtgatagaagatataactcatctgatacctgcagaagtgaaatggagaaagcctctgatgattacgcaatcctcaaaaactatcaccccttcttattcttctttaactactcttaacgatctagacgggttttcaatccaagacttgaagaatattttagtttgttcccaagaggatttgcatgatgtcttgcagcaattttcgatgactttacaagatttcaatgacacgaagctgcagttacaaatggaacttgataactttaaagttcaatggaatcatgaaatcgaattgaagaaatctatgaaatccacaatcaactctttagaatcatcaaaagtattgtatgatttgaaaagggaaaaattggaaaggtcaatcaaacaattggaaactaagatagcaaaaatgaactctgacatggaagcttgggccaatactgatgatattgataagaaaaaatcgacattagacattaaatatgaaaagatgttaacagagttaaacaatgagatctcggccacgtccaggcaaataaaaacattacaaaatgtgattatagaacaagaggacgaaaataaaaaactcaaacagttaaaaaagcatatggataatgaaccaaacggttcaggaacgacccaggttcaatcagcagatggtacaacgatcaattggactcaagtgatgaaaagaattaatgattctactttatccaagtcagggttattgtcttcaagcggtgatgatctattgaatacgttaccgtcgcaatctcaactagtgcaaactatcagatcggagattgacatggactctaaattggataatcaatggaaagcctctaaacatttgtttaacaaaagaattgaccaattggagaaagtatggaaagatatgcaggcggaaaatacacaacttaagaatgaacttacattacagacatactcgatgtctcaacaaccttcacaacacggtattaatggcgatcttgctggtcagaatcaaccccaagcgcatcaattacgcctgcatgatccttcctcctatacaaattataatacatctggatctttgctggcgcagaccgtcgcttctgctccatttagctcttggctgcaacaaggacagcagcagcagcagcatattgaccataatcagattcctcactcacatgatcacgcccatagtcctcctttgtcaagtcatgaaactttttaccacaatactgagtatgaggattcctcgcatctgatctcagctcttgaaaacatggtttctgatgttggtgacaaaccaagaacaacgctgtccttcacaaatgaccaattggatgactactggaacagttcgagtcaaatatctcgtcctttcagtccatcaagccagcagcaccatttgcagcagcaagcacctcaacatatggcgtctatcgggtcatcccaatcatctctgtcgcctgccccacaattcaaacaatccgatagaaacattttgggggttcttaacgatcctcaaaatgatgacgttatctctttccagtcagcactgaacaatggtccagcatcatcaccgatggtaattccttctaaaagcatgcattctgtgcctgatacggcattttcgccatccttccacagcatctggaatgacagcactgttgcttcaccacattcttccaaccatgtgagaactgatagtcagcagaaatcgtgggtgtttaaccagcctgtcgaaatacctagcgaacctgcaacagagagaccaaaggaaagttcaactcgtcgaatgtctaaactgtttgccagagggacacagttgtttaaattaccaagtcatgactcacaggctagttaaaccttcaaccagccagttgacaatattattataacttactaatctttggttggtatcatcattttcattcataagaatagaataaaacgtcatgctgtggatatgagaggcaatcattaaaagcgtatatagtacaactatgataaatatcattccccttatatactaaagcctaacttctcgtagctccgattactacaacccgagttgcttctttaactcattctttcttctttgcaccaaccaaagttcgacatcttttaaggatggaacgtcaaaatttggtatcacaaaagaagggtcccgatcagaagaatgaatagttgatcgaagtgagccagtacgtttcttctcatattcaagaagttcatcactgttatttcctacaaaatagtcgtctttcaatgtactttcccatcgtttgattttcctctgcaactccgctttcttttccttcccacttctttccttctctctttgttccttggattccctcaataatttttgaacctctggtaattctaaagctctaccgaaataccttttcccatctatgagggttccgcctgtggtatttaactgcttcctcttcttcaaatctggaccctttaacttatttctgatatggaaatcccatctgcccttctcctggaatagtttattgagttcatcgtttatttccgtgatttgagactcgtttaacgatggatcatgaatctgtgtcacacgttgacctatctccttcacaagctcgtttctccatcgaagtgcttcatccaacttcgttaccttattgatcctggtaggtcttttcaaccgcgaaaaatcctgataaccaccggtttcggcagcctgtagctcctggtatcgcacgagaacagagttcgctttattcacgttacgactcatcgttacttcgccctttctttacctcgatatcccgtataatcatcgatttaactctctggttttcttctttgggattggttcttgtagttttatttcatgtcctttcatcttttcttaatatctgtcaacataaaaaaaacataataacatgaaatctatacagatagaagacgacaagatagttacagattaaacagtgctataaattccgtgggcaacgcgatctgatctactagaaagctttcgttggtcactccaaatattcagggtttatagctgtgttcatttgctggtttctacggcgagaataatctgaatcataactaaaatcaaaaaaaaagatgcacatcaattctgtggttaggaactataggttcctcatcggggccttaactgctttgatgttgcttcttttgctaaggtcgtcagcatctccacaagttggttcattggcgaactccaataaagtcgacacaccagatgggctaaaagttcctggtgcttcttcaccaatcagtcaaaatatcaatgaggattcacaaaagcaaacagccaaagaccacacatcccagaatttggaatctggttccaattccctttccaaatctcagtgtactgagggtcataagtacgtggttatgattgatgccggttctactggcagtcgtgtacatgtgtatgaatttgacgtttgtacccaaccaccaactttgattaatgaaactttcgagatgttgaagcctggtctatctagtttcgatatcgatgctgtgggagccgctaagtccttggatcctttattgaaaattgctatggatgcggttccaaaggataagagaaattgtacgcctgttgcagttaaggcaaccgcaggtttgagaatgttgggtgatgaaaaatcttcaaagatcttggcacaagttcgtaaacatttggaacaggattatccattcccagtggtcgatggagatggtgtttctattatggatggtgaggaagaaggtgtctacgcttgggtcactgcaaactatctgttgggtaatattggcgctggttctaaattaccaacggcagctgttttcgatcttggtggtggttctactcaaattgtgttcgagccaagtttccctcctaatgaaaagatggttgatggtgaacataaatacgagctaagtttcggtggtcatgattatactctatatcaattttctcatttgggatatggtttgatgcaaggtagaaataagattaacactgaattggtcaacgttgcgatcagctcgggaaccattactaagggtcaaactgcaagaacttatgaattgagctccccatgtttacctccgggaaccactgctgaaggcgagaaagttaagattagtgatgacgaaatttatactgtcaacttcaagggtccaaaggttccggctggtccacagtgtagataccttgccgataagatcttaaacaaagacgctaaatgtaacacacctccatgctcattcaacggtattcatcaaccatcgttggtccacaccttcaaagaaacaagtgatctatatgtgttctcgtatttctatgatagaacacagcctctcggattaccattatcgttcactttgcaagaattacaagatttggcaagaactgtgtgtaacggtgaagaagtttgggaaagtgtctttagtggtattgaaggatccctgtctgaattgagcaaagaaccacaatggtgcctagatttaaatttccaagtatcactattacacactggttacgacatcccattgcaaagagagttgagaacagcaaagacgattgctaacaatgagttaggatggtgtctaggtgcctctctaccactattggagtctgctaattggagctgtaaagtgtccaaggttgagtaaaggtaactcaattcgaaattttataatcatatacatcgtttaacaaaaatacacgtaaatacgctagtaaaacaccaatcggtcgttgcgtggccagaaaggattgcaaactaataaattgtgtcgatatataagttttggggctccgaaagagcgtcatttacctgatattttttagcttccccgtattttcagtaatatcttatctaagtgcatcactttccttcaaaaacatgctgaagcttaaaagtaaatgaaaatgtctaagagaaagggaaacactcaatttgtggaaagaaaagcttgaaagaggttccactcagacggattctataggtgcaaggaaacgaatcgatagtgttctgcgaaatatggttgaaggacaccctttggagaaggttctgagtgctagtgcactaacttcaagcagtaacagctcatcaagaagtagtattcccttgacatttgaagtcactcatcaacacaagactcagatcaagcggttccagaatgtgttaactagtgatagtgccacccaagatgacggcaacgatgaccctagtagaaatcaagggaatgaggtgagtgaacaatttcatttgctgcagtatcctgagcagcatcaacatcaacatcaaaataaacatcaacatcaacatcagcagcagcacgaaaaaggagatctggacgaggtgctctgtacccaacggatgttcaggaaactatctactgggagcgatgatgtgaaaaaggtttattcgcatgcacagctatcgtccactgcacatggagtgagattattatccaaaaatctatccaacaccaaagtggcattagaagttaagaaattaatgatagtaactaaaaggcaagatgattctttgatctacttgacaagggagttggtagagtggatccttgtcaattatccaacgatagatgtttatgtggaatacggttttgaacgaaacgaatctttcaacgcaaaagagttgtgtaaagacagtaaatgtggttcgcataagattcaatattggtctccagaatttgtgaaagaacacgaagatttctttgacctaatcataacacttggtggagatggcacagtattatacgtatcatcaattttccaaaagaatgtgccaccggtcatgtcatttgccttggggtctctaggattcttgacgaacttccaatttgaagacttcaaacatgctttgtccaagattttacaaaacaagattaaaactaagatgagaatgcgactatgttgtcaacttttcaggaaaaggatcaagaaagtggacgaggaagcacgcaagacgcatattaagtacacaatggagggagagtaccatgttttgaatgaacttacgattgacagaggtcctagtccgttcatttcaatgttagaattatatggagatggatctttattaacagtggcacaagcagacggtctgatcatagcctcgcccactggatccacagcgtattccttaagtgctggtggttccttggtataccccagcgtcaacgctattgcagttacaccaatctgtcctcatactctaagtttcagacccatcatcttgccggatagtatgacgttaaaagtgaaagtcccaaaggctagcagaagcaccgcatgggcagcatttgacggtaagaacagagtggaaatgaagaggggcgactacatagtgataaacgcaagtccgtattcattccctacactcgaagcccgcagcacagaatttattgacagtatcagtagaacattgaattggaacgtcagggaatcccaaaagtcgttcacacatatgctctcaagaaagaatcaacagaagtacgaaatacacaccgtgagaaccaggcaggattctgaagaagaggaagaactcgaagacgaccaaagtgatgattattctactgactctgacagtgaactgaacgagtaaggtcggagaaaaagttaataccggaggaaatagcggattttctgaagatctgcagactattttcgcagctcacatgtgtttttataaaccgaacttttacccaattagtataactgaaatgtcttgagagtgtttatatttacgtttaccattcttaccagtaatcttcctgcaaaccctacaactccatacacactttgtacaccactcttcactggttgacccccccattcatgtatttttatttcctatataggaagcctaagaaacaatcacaagtttatttgcatagatatctgcgccatttgttgcggggagaacggccaagaactgcgtactcaactccaagctctgtgatgtgttgttggaaagctacgaaaaatgcttcctctttgacgcctttttttaaacatcgcttttgccccaattgggtaattgctgaaaaaattctcaaccgaaatttctcgaggcgcattctgcgaaaggtggaataaacagaggagatagtacagcttcttcttaggaacaggcttagtgtgctattacggcagcccggcaagaaactatatgtacctgtatatcgatatatgaatttatatatataaggatataaaatttgaatgaaaacccattcaaaaaagtccaaggtatctcttgttgcattctttcagttataaatagaatctaagattcaaggtaacataagagagccaagctcctcccacgcctataaataatatacttttgtaatgagatcgtttgctaaagtgttggccctagcggctgttgcattgaaagttgtttcagctgctgatgagacaaccacctgcagtgaagattctcactgcccggaggataatccatgttgtaatcagtacggaacatgtggtacaggtagttactgtctaggtggttgtaaccctaagttttcttacaagaaagaggcttgtatgccactgccagtttgtcgggacacaattaccatctttgataattatacttccaaaatggcgaatctatatacatacctgggtgatgcctcaaaggccaattggacttacgaaggttatccgatcgattatgaagacgaaaatgctttgattatggctatgccaaaaaattctggcggtactgttctttcctcgactcattatatgtggtatggtaacattaaaacaagaatgaaggcatctcatggtgctggtgttgtctctgctatgattttgttctcttctgtgcaggatgaaattgattacgaatgggttggtgctgatctagagaaggtgcaaaccaattggtactggcaaggtgctctgaactatacaaactctaagaatttgactgctacgaacaacgatgaggattatcacatctatgaaattgattggaaggaagatgttatcacttggtcggtggatggtgaagttggtagaactttgttcaaaaacgaaacttataactccacttccaagcaatacgaataccctcaaactccatccagagttcaattatctctatggccaggtggtaatgccacaaacgaacaaggtaccattaactgggccggtggtgaaattgactgggactccgatgacatcaaagattatggatactactacgccgtgttagaaagtgtgaacattacctgttatgacccaccatccggtaccacgaaaaacggttccgaagtataccaatactctggtgaagacaactggttgcaaaaaggtgtctttatcaccgacggtaacactatattgaaggattacgataactctggtttggatgacaataccccagacgaaagttcttcctcttcttcttcttcgtccacttcatcctcatccaaatctagttccacttcaacaggaagcagctccggatcggcttcaacaacgaccactgctggctccaatgacgatactgacgagtcatcttcttcttctacaagttcttccgcagcagcaggattcgttcaaaatatgtcgactacttctagctccggtaactccagttctgctacatctactagtgctgctggtgctgaaaagaacttgtcatatgggtttggtttaagtttaatttccctattgttatcattgctgtgataacaccgaactgactttgtaaatcacacgacgcatacgaaacataaaagattctcaaaagctcaacaaaaagattctgtggaaatttatatagatgaccagtatcttttgaaactcagtgagcatgtacatatacagacttttaattaaatgcacttttttgatcttttgatctttatgacgaagaattttatctaaatacggagatgtaaaatatacattgtagataatagacgggatgtgtgataacactaataaaataattatgatagtaataatactcgatattaaggcaaaacctcacggtgttcactggggaccgggtgttaagataaaaggaagaagaaagagttgataatagaagtagtagagttgttaaaaaataaataaataatcataaaatttggtattcttggaatagtagtgcatagtaacaggattccaagagttgtgatagtaacgactttttgttgattcaccttcattttttcttcatttgtatcttggctcaagttgataacttggagttttggttctatcatgaaaaggttcgttctttattgttttgcggtatatcaaatgctgatccttctgatttgaaagtctttttaccagtcaataacggatataataattacaagtataacggcaaaaaaacacaacagaatggacgagtataaggatgaaaagaagatcacatgataaagaacaacgaaacgaaaaatatacaagcgttgtttcagagataaaaatccgtaatctcttgttaaaattccaaaatcctctttttttataagcagcagcaaacttagaagaacgttcatagacagttttcaaactgtagaaaaaaacattaaggaattttctctatgcagagagaaaaggtgaaggtgcaaaataaaagcgttccgggaagggtgagatggtgtatatacataatatcaatctaccatgcgtgcatgaatgaattttttcttttcaaatgagagaagcatggaggttaaaggaagacatttataggaaacaaaacaaattgggaaagttcatttaactcataaatgtttatttacaagccttcaacatgtaagtaacgatatcgtttctgtccttttccttcttcaaaccaccgaaagccatcttggtacctggaatgtacttctttgggttttccaagtagtcagacatagtttgttcatcccacaagacgttcttcttgatgttagcgtcagtgtaagagtaaccggaagctttaccagagtgtctaccgaagacaccatgcaaatttggaccgaccttgtgtggaccaccggcttcaacggtgtgacattgcaaacatctggtcttgaacaaagtagcacccttcttttcggaacccttcttgtatggagctggcattatgactttatattagttgtgttggttgtgtaacagttatttgatttgacgaatcaatccttaatactgatagtttgggaaactttaattaagatagaaaggagaaaaaagaaaacgctaaaaagacttgctaaagaaacatcaaattcaatcgaatatcaaatcttaatatgttagttatatatgaaattatcaacaaaccatagtgcgcatactaaaatttttctcctacctgtttttaactacttaaaccgaaaaaatgcttcgaaacaagtctatcatttcgggaacatcggtcaagacacgagatgagccaaattctgtgaagcctctgagacttttttctcattggtttcccgttgtgcgttttgctgcagggtaatcttaatggggattaaagcgtggggaaaagcaattcttgtcagaggttggacgtcactgtgaacggaagcgatctgattggttggctgatgtatgttacagtcacgtgatacgtactgaccggcacgtgacaattaacttaatggtaatggttctggaatatctctgatcagtgttaccctgagaagatgatattttttcgctcatattatctgtatttgacatcaatagagtatttatttacttcattctgttctttgcgtgaatatcggtataatgcacacgtgacttttggtgtgctcttcgttagtgccgatacgaaaagcgtgccgtgttgttaatggtaatgcggttaacattgagactgatcaccaagcaggtacttgtgtgttcagtgcttattaaataatatatatatttgaagcgtgaaagttctctgatatctgtttcacccttctcctttcacgttctgggtcttttatgctgcggagaagattcatcatcactactgtcatcccgtggatcgagtagtactggaacatccatggatggaaggattagttctacaattttcaactgatcggatttattgaactctttatcgcttaataaactattcaattccccaaccgacatacatcttctcttgaaatactcttgggaatagaaaagtgacgggagttttaatagttcccacggttggatatcgaagtatgtagcgttcagatgggtcttttctctattcaaggttctgtcaacggtataaccttgattatttattacaaaaatgtaaggtttgaaaccgtgcgtcaatatggtgcttagttcttggaaagtaaattgtaaagacccatcacccaccattaatataatcctatgcttatccaatgtccccatatcgcgatatgctgccaaaattccaaggcatgcaccgatagaataaccagatgaattccaaattgcttgggatactagcctagtattatctgggaatttttgttgtaggagaccaatagctgaggtaccagattcagaaataataacgtcaccttgttttagccatgtagacatcttaaaccaaaggtactcctgtcgcaaaaatgtcaccggttgcggttctactctgggtatcatattcggtattgttactggacgagagtttactattttggtagtatctaatgacgctattagctgtgggagtagttcatgaagtaaaatatcaggtattatattattttcaattttaactctatcattccaaagtaagatttggtttttactcttgtagttgaatctacagtacgagtttttgaagttttcgatcatacatcctaaaattaacgtacaatctgcattattcatatattctcgaacaatgggctgtgacatggtacctaagaaagtcccaacaaagttgggtaagctttcgtcaatagaaccttttgacattaaggttgtcacaaatggtattcctgtttccgttaggaaattttgtattgtgctgttgtaattatatctatcaattaatgcatcaaccacgatcaatggccttgatgaagcgtaaacttcggcaatgattttgtctataaccctctttattgtgtccgtttgaaagaaagtgttctttatgcccatcttatctgctatgtttccgtttagagaactactggggacaagtttcgtggcatccttcgatcggaggcccatataaacagggcgtttcccccaaaaaagcgttcgtacacaactgtctatctcagaaggatcatccactacgtcatgaaagattgaaacatctccaatcaacctctcaagatcatgagactgttccaagacgactacctgtaagatgggaacatattcacaaaatgatccaaaaaaaccattaacatggcctaattctgcagattcgctagtgacgtagcagctcactccgatagctctcccgtatgcatctactgcaaatgatgtgttcaattgatttatcgtttggatccactgtatcccgctggctgctatggcttgatatagtttcgcagttgaataattggcaactccaaacacagtacggcagttgagctgaaataatctatgaaaaagatactcaggcaaaggtattagcggtgcgacattatacctctcagtatagctcatctccttagcagcccctgagtgtatcagggtcttggtttccatctttttgtccgtcccagtatattcctgttaaacttttaattcgacttctcttcaaggaaaatcaattttgtcaagttagttcttgtacaggaaaatgtgacaaagaaaatgcaaagttacacgatggacaaaaggtaacagtagtttttaagtactcaatcgcacgcacgtcatgtggctcttaataggtgagtattgatattattatgaactgacaaggtgaaatccggtatgaaaaaggtaggacggaagctagaaagaaaagtattgctataaaaggaagaattatgatgtccaagtgcccttttcctagtgaggaatagggaatgcttaacataaataaaaagaatccactgcccaatatgaacactattagggacaggatagaactataggttttccgaaagacattgaaatgaactttaaaattgaagagaaatatgatatgcaaagggggggagcgtaggatagcattgaacaacggtgttgcctgcaacaagtaggcatatgagaagtaactatttgtatgcacattaatttcgtgtattaatttcattttctttggatgtgctgggtagaacgttacattaatgcatttgtatttgcatatttccttctctcaactagtctttttttttgtttttagttttccttttgtcttgtcggttctatatcagtttgccagtcaatctatatatatcgttagatgacaacccttgtaattcactttcctcaaaatgtagcaatggtaaagaatcgatcaacgaaaggtttgagtccgacccggtgttgctgacgatatcagtgaagtacgtcgaattgaacatacattgtaaagcgctgtatctgatattaggatcatatttcatgatatggtataataagtctatagtttcctgtgtttccttcttgaagatcctattcaatgggatcggtctgatctgagggaacttatgttcggagtagttttcattcatggaacagatctcttccctggttggtgtacccaaaactttaataatttcaaccaattgatcgatcttagattcaccagggaaaatgggttgtcctaatagcagttcagccataacacaacctgcagaccaaatatcaatctttgttgtgtaattggtagcaccaaagatcaactctggggctctgtagtaacgggagcaaatatatgacacattgggctcgtttggtttcaactgtttagcagaccccaaatcacagattttcaacagtaaagtatctggatccaccaaaatattctgtggtttgatgtctctatggcagacattgaccacttgatgcaaatagtttaaagatttgaacaattggaacatgtaaatcttgatttcgtaacgatccattggttgatgcaaggaaatgaactctttgagccgttgataaagagacatgggcatgtaatctacaatcaaatttagataaagttcttggtccgattgttcaaggaaatagtacttcaaatcgatcaaattcggatgactgatcaatttcatgatctccagttctctattcttaaaccgtctatcctgtagaaccttcttaatgacaacatcctccccagtctctttcacttttgttctgaaaacgacaccaaacgaaccatttcccacaatttcaggtgtgccgcatgaaataacaactgactcctcggggttggaatggcctttcaccacagtccttcgggttattacttcgtcttcatctggaacgattttaacatcattaccatgactgttcttactatgaagactgccttgttttaaatcatcactgggtaaaatggaatccatctctgtctcaaaaccagcgtttttatcgttagtatatgcaataatagatcttgaaccaccggcaccgctactttcgagcaattcaccaactttcattcaaaaaaaaaaaggagtattgtactaaaactatgctgacatgcacacttttctctgaatcctttctctctcacaacagataagaagtgattgatctgtctgtgtgtgttaattgttatatgcgaagtcttgttcttggtgttcttttttttttaccttaaatttcaccaaattttccaaaaacttcaaacacgcaacgtcttctaagaccagtaaaataaaatattcagcacacgcactcacaaacacacgcgcacaccgattcaaaatattatgcgggggggagagaatcaggttaaaaacaacagttttatcgtctttcttgtctggctcaatgaaaaattttccaatgtcctcatgtctttctcaaagttttattcagacaataaatactaagcggaaagagtaaactaaaactgcttgcaaattgctttgttagtccagacatttattgtatcgaatcagcttactggaaaattgaaggagagagaaatcgaaatagtttttttttttttgcctgaaagcatgactgggttgagagccttcccttgtatatgcgtagaaagcaagaaaagtgttttgtctgacagaataatctaggaactgactagccagactactgaacagtttgccccttcgtagtattacttaataggaagaagattgcttgttcaaatagtatagtttttcctggaaccggatgccagggaaaagtggaagttcgtgagtacttctccgttagtccgatcacatccaggaaaccaagcagggaagccactcaggggccacctaggcagggatcaaggacaaatggagcaaagggtgccgatagggaaagggggtcggaaaaaaagttccaaattgaaaattgtatacatacttgttacccgacgtgatggggcggcgttattgccggtaatttgtttgtggggcggaacggtagacgaagctttggatgtcacgtgtttagcatttttgtcagaggaagccgttgttgtcgatgaagacgacggtgatgaaatgtcagacgcaacgatggattccatcgctacatcatgtaccaatttcagttcgtcttccaaactgagctgtttcacaacgagctcgacatcgagctcttctgtgtatctgtcatgacaaggtagtgcaccggcagctttatccttgctcttgctcttggccttgccgttctgtccagttttcttgtcgacaacaactggtacttcggctaccacttgtggaccagacttgcgtctggtccacgtgatgccctcaggattgtatgttggatgaatcttatctctaatctttttgaacatctttcgtctgtattgctggtggttacgactggtcggggtatggcttttctcgttcttggtgaagtcatctaaacgatggagtttatcaacctctggtgttatatacgcgtgaattatttacacaaatttttcatcactactgtaaattcatttatcagacacaaatgtcgtgcaagtaatatgtcaactgtggtttgtgctgcttgcttctcgtaatcgctttccactctgtgcattaaggttcttaagaaatgaaaaaaaaagctggagatatgggggagaatgtccaatgtccctctgttacccggccagctgacgcaatcaggcgcaaagtcatccggtgagtaaaacgtaggtttctagccaggtcgaatctagattattcaaatttgcatagcataagcattcattgcctatagagtggtgttacttaacttacctactatatggatataaagacttgaagtgtaggttgtttgtgcacaccccttacacttacaacttggtttgcttcgagaaagctagacccttcttgatgttcttttctaagattggcaagcacttggcgatcaacttcttttcgtcatcgttcaacttatcgacccattcgtgttctacagcgacaacgatacctttctctaatttcactggagcagagaagaattcaacagaagtatttaacttcttttgtaattccttaccacctggcaaaccaggtaagtaaacgaaagttgggattggatgttggtcaccagcggtgttcaaatgcaaactgttcaacaatttcttagcaaatgtgtaaccggcccaagccatggacaaagtagcactaccgctaccgtccttggccttcacaacttcatcaccaccaaactgaaccctgtgtacgtaagattcgtaaacgttggagtctcttaaacgtctgtagaatttttggtcagtaaagattggaatgatggtctcaccagaatgaccaccaaccacggtaactgcatccttcaatttttcaacggagtaagctttacggccaatgatgtctactaggaaagtgtgagatctgatgatatccaaagtagtgatacccataaccttaccggcttggaacttgcccatgctttgcaaagtttcgtaaacaattggaaccaacgagttcactgggtttgaaatgacaaggattctggcatctggtgcatgttcagcaatttgcacagttagagacttgatgatcttggcgttgatcttgaacaagtcgtcacgtgacatacctggcttccttggaataccggccgggattatgaccaattgggcacctttcaacgcttgaccaatctctgcggtattgaaaccttcagacgtggagttagtgtcgatatgagacaaatcggtagcattaccgtgggacagcttcaaatcgtacaatctcaaacttgatacatgagggtctagtttcaacaacaacgaaagtggttgaccaataccaccagatgagccaagaactgtaacacttaccatgactgcttgaaaacttgactattactttaccggttctacctatttgaactgatagtatccctgaaatcagaagaagaaagagatgatgatatttatatcaataagtgctgaaagtctctttcaacaaaatatcctaactctagggtatgtggacaatcccagaaaatcgctatgtatatatatatatatatatattcccgtaaatgtatatccaaatagttaccaattaactagtgattttccggtacttttctacttctaattcaaactggctttgtcaaaaggtagacttttttttttttcaattggcatttttccttatttccaggtcgccccgagtacgtaaagttagagaggagaacagagtcattgtgagatggctagatattggggcagttagtcaggcagggcttttaatgtatgaaaagtaagacttggactgataaatatgagtcgttattacaaagcgatccatctacgtaactacaagtcacttgttttcaaccagaagcgcgcgcaagggaagagccactgactctcttcatgagttctattcgtccattttggctcaacgagctttttatccgtagtgttccgatttcttccgatgtataagggccaaattcatgctctgtatgcatcacgtgacttcccggagttatctcatgtgaaactttagattttctggtctcctttagggatgattccactgacgtaccgcgagctcccttcatttgtcctctagtaacgttattagctggtccaatccagttccattcaccccgcttgtaggtattacccgcacactttctggatccatctgtagggtacgtgatgttatcattttcacgtgatctactttcttctgtaaggtatcgtcatcattaaggccgttaccattacccttcggaagtaggtcaatcttatttaataggatgaatacctcgaattgtaagttgattctgtcattctcttgtacaatctcttctaataaggttaaactctccatgagtctgttatccaagatatctattacccatatcaagtaatcggttttctcgaaatagttaaaccagaatggccttaatgtcttctgaccgccgatatcccacatctgtagaaccttgttgcttagtttcaaagtcttgatttggaatcctatcgtgggctggatcttatctataggttcattcaatagctgatttaggactgtagtcttcccgctgttatccaacccgagcaatagtactcttcgtgaattgtctttcaacttctgttctttgataatttgtagcaggcccattttgttatgtgctccctctcgtatactagtgttctggctggtgattgtcagccatttcctattcaccttaacagctcatgcacgatttctcgagcaaagtatatatgttttctttttcgattttcctagtgtagctatttataacgtttatcttttttgcaattatactcatcgcacattatcctaagagagttcaatttgcaaccaccgtcatctgtggcctctacttccaaagcatcgcgcccgactatcaagatgcctaagatatgaaacgagttacgaaaagagttcaaagaactcagtctcgtactttgttcgatttgaagttcgttcgtctgaaaacgtccgttgctaccagtaccacaagtaacgaaattatagacttaactcaggaagatgaatatgatggtactgatacagattatgttactgcagacttcaccagttgtttagaaagagaggctagcgtcgatcctgaaactccagttgctgggggcagtcaagacgttaaaattgagggaaagatatcacaggcacaagaagttgaagttcaagtccaggttcacggacaggcccaacctaaatctgagccagctgttgtagataaaacttctcggaaaaagtccatggcatggttcaaaaaattaagtttcagcgatataactgttgtggttgattcttttaattgtgataaagaaccaaatatcgatttatattttctttcccacttccatgcagaccattatggtgggttgaaaaagagttggtctcatgggactaccatctacacttcagtttacactgcgaatttagtcaagtggaagttcaaggttaaccaatgcaaacttattggattgtctttgaatgagtggcatagcgtctcaaatgaagtgcgtgtcatattgctagatgcaaatcactgcccaggctcagtcatatttttatttcacgatctacgaagaaacagttttgtgttacatacgggggatttcagagccaatgaacggatcattactgaagtaaattcccttcttcaaggaaattccttgtcgcttatttatttggatacgacttacttgaatccattcttcaagttccccgctttacctaaagtatgtgaggtaactgctgatttcgcttcgctattagcagaaaatgggttgaacactttcctaaaccgttctgatagccaaaggtcaatttctcaatatttaggattatctcagaccaaaccaatcctttttgttgtgctaagttattcaatcgggaaggagcacttggctatttccattgccaagaaattaaaaacacaactctatgtaccgcatacaaaatatcagctggtgaaacaatacatctcatggtttccagagggtctactcaccactgaccataagtcatccaatgttcacttggttgctatgcacacagatttggataaatatctttctcagttgtccaatatgttcgattctatagtggtatttcgacccactggctggactttttcaaaccaatatgataagtcatatacactttgggatgaatttgaaaggaaaaactgggttaaggacacattgtcgggagagacaccatttgccattgattatttcaccaaacaaaaacgttcgcagggcaaaatctaccatttcaacgtcccgtattccgaacattcttcatttaaggacttatgtctgttttcaacaaaacttaagtgggataagattattcctactgtgaacctttctcaatatagagaaatggcacgatggttcgaaatatggaaatcatacaaaggatctcaataaacaatggcatataatcctcattgttacattaaactacttattattttaataaaaattagtctgtccgccatgagaatgaaaaaaatgttaaacaaaatatccttttactattattacagttttaaatgtcttcgttgacaatttcactcaggcgttgtctttgatttaatattgaaattatcatcaaggttatcattattctctaatgattctataaaagaacgaggaacgttcaagctttcaggaactcttctgtcctctggacccttcatctttctgtaatgcatgagaatgttagcatcctttgtattgaattttctgattaacttgcagtagaacaatccacatgcattacacaaggtcctattaccgtaaggcccccttctccattcgggagtaacggtttcatgacagtgtttacatgactcggtaccatctcctgccgctacgctaatcattcgttgctgctgtgaaacgctgttgcgtttccttggtttgactttatctactttaaaagtatgacttgttcctccgatggaactatcgcttttactgcctctatgtccaacaacttgaatgaccggcttttccatcttagtgttggtagctgcggttgggatttctacttcagattttcttactgtgacgttgaaaacatttttactcctgggtctcattgggaattgaaactctgtcattggcttttgtagctcgtttctaagctgattaatactagggagttgcggttttttcctgttccaatcgttcatgttcttcaactctaacaacctattcgtaacctttaacatagatcttgtttcgttggaaagttgggtgagatcattgaccaaaacatccttaatcttctgggaactccatgtcagcaaatgaaatgtcaactgttcattgtactctgatagtcttttcaaaatccgtttgaattcttcttgattcatatcctggtcgatcgcagtgtcagccaaaaaatcaagggatccacttctatagtgaccaccgtaatggtagtccctttgacgaggactaatttgcggtgacgaatttgacgacgaaagaaaatttcctgtcgttgaaacggtaatgtttgtttgtgacgtcttgtttgtccgaatactcgaatcgttctgcctgtcgtagttcaatagatttgggatggaagcaacactatggtagctgacactttgggataatgattgaggtgttctcgatgtaggagttgcagatgatgaaatagaaccagatttgggactttgggaccccttttgtgccagcgacgctgtcatagtttccatgaatgtcataataacaattatactgactagccgtatgtctatttatgtgtatgtgtgataagcaatgttgaacgaatatattattcaaaatgatatcgactgtgtcttggcaaaaaaatttggtttggctctgtggttctattttgttatttcaattgaatgataatgagattgcaatctaacgagttacctctctgttagtttcgaatctactcttggccttaaatacctggcttatttgatgttcgaagaactcggaaaagtacgcatatatttatatcatttcatttttgtatagatcatttcagttccttaatttgatttgacacttttttgtcatcagaatctaagtaagtttcaatttagaatatagaaacggcttggattgcctcctccatttcattattgatcctaaaccaatgaatattgaaactgtaaagtttttaaatctgtgttatgccctcgatatgtctactgttttgtatattactacgtaaaatgtcgactatagctgctatgagtgacatctcatgaatcgtttccctctacttgaaagatacaaaaaaaagagtccagattcaagaagatttaaattgagaagtttctcgattactgttatctgaagctacaaaccacgatttgatatctacatgaactccttttcttttcagaattgatctgtcccatttcctcgtcgtcagaggcctgttcccttatttattcacaaaggtttttcacgaaatgaaccttaacatcacttagtaaagaaactgggcattatcaacagaaaaacaaaaaaatgagcacctaattgtaagttgaaagtgagacttccttagcccctaatattgaaagaaagagtggtactatactatttgcgctaagcataagccaatctagttttccctagacttattgcttcatacaaacgatgaccaattttaaatctacctatgagaagaaatctttcactagagaacaatggatgaaagtggtgcaggacgccaatccctatgatcgcagcaacagtgagttgtcgaataatgagccggtaataccaatgttattattgaactattttgtggtgatggcatatgaggaatctagtatccgcatggctaaggagcttgggtttttgaattccaacaaagacattgaagaattcaactctgtatatatgattaagaaaagggcatacatcaaggaacttatcaagaagggtgaaattttactagctatggaaaagattaccgaggtatttggaatagaggtactcgaaagtttgaatgaccatattacagatgaagatttgaacttcaagctattgttgttgaaccttattgaaatgattcgttcccacaacgccaagggcgaccctaacgatcaggagcagtttatattagagcttatctcttatgctcaggataaacttgctttgaaagcaagctccaaaaaagagtatatgaaggaagtcgaattagttatgacccttcttctcttcccgttatcggatgaggatggttcgagtccttctgctaagttaccaaagaagttgaaacagctatattccttaaatatgagaactaaagtagctgatctagtgaacagaaagcttttgcaatcgatattaccgaggataaactctcaactcgaaaaatctggtttacctgacatcttaggatccagcttccaatcaaatcgagttcccactctaacaaacgttatacgatccattccaagggaatctatcacgacagaaaggcttaccggagagctagcacatattgaagaaaagcagggaagttctatgagcaccaattccgacatgagtcgcatacaaggtgaaatctttgaagagttaggtgagaacttgcattcttattatatccctaacgacgttagattggtacaaatcatgaaactttgggtttggtgtgaaaaccaattgcatagttcggatgttggtgttccgagggttgaaggagtgatttagtgcaaaatctataatcttttatactatatatgcatgggttccctatattcacattatgttttcaagcatttaacggcagcttgcaattttcacaccaaaaactcacagtctatagtgtcaccagtttccatctttaagaaacacaattgaatatcgtcgaggttttttggaagttcctcgctcatggtgttgtagatttttacatttttggtaatggtgaaggttttgcttggctgtttgaactgatcataaaagtgaccatctttaaagaagtgataaagttttgattttaatagccttaatgtacaaccaaactctggtcttttttcattttcgaattcttctggtgagaattcaatgtggaatgtgattggattatccaacagaagctttttggtatcttcgtcgataacttggcatctaacgtatatgtgagcgacatgcacaggtttggcaaagaacttttccctcgattcgaactcctcgattatgagaccggatttttcatcaaaccattctgtggcatggtacgaatcgtcatgtatgaatcgatggtttctaataaaatcttcgtccaatttagtgctgttcaattgttcccatgtatccatttgtaaggcactcatttgaattgttatgtagagttcattcacaagagcaaatcctcccatcaccacaagaaaaagtgttattcgggcacttagcgggtcatcagtgtattgtttaagaaagtttacttttctgatccaagcgatcataatgctttccaattgcaaatagtgacgcagcaccgtcgcgcgtaattcctccatattggccttttcaggtcttataaagttatattagtttgcaggtcacctttattagctcgcactagtccacttcaagtgatttctatatctttacgttttattgcatttgaaggtgtgtagtttcttctaagtttatcgatttacaaagcttgtttttcatgccccgacgttaaacgagaacaacatacatatcgagaatgcacatacattcttcaaacaattcatgtggccagcttctgtagcgaccggaaactgactctagttaaatggtaggtatgcttttggattactctgatatatctaaccttaaactcctgactctaaattctaactgttataaaagaactcgtcttacaatcattaggctcaagcaggcaataggataacgtcatttaaaatatcctctgacatttgcatacttctatttatcggtcaaatatccagtttatcaattcataatggtctgaactacattcatgctccatttttttatgttacagcagcttgtctgcttcttacgatgaaagagttcctgctctccggtctttgtattctacagtcttcgttcctgatatctcctgtttagatctgtgaatggcaattcctatttcgtaattatttgacattaccatttgtagaaaggttagtgtttaatactcttgactggcttgcccctgattatgagatcggttgcacaacacaaaatagtcggcattgttactggaaagtctttcacaaaagggcccagccataagatgcctaacctcaaatctacaatttctgagcaatgaaagccaaatgtatcatattcggcacatcatcatatttagcagctagcttttagaggttcatcatgtcacagatatcttcatcatatattgccgaaaaaggaaacccgccgacagtatatataaagtcaggccatacaggcgtaacaataatgtaagtcgactcgctggtatcaattaccaaccaaaaaagtatccacgttaacagatatataatggtaagacttagcccaattttaattctagctacaatcgacgcattcctgtgtttagccgcagatgaaccatcacctgaacaattaagttcagccaaacaagaagctgcagctgctgacttgcagttcttcatcgaattcttagatgattttaacgtgaacctggtctcatatacatcatatatgaatgaagcaaaaatgacattgccgcaggatgttgccaattattactatcatttgaaaagtgtaactgaaaccactcaattgcttgatgatttagccaccagcttcccattcactgagttcaagacttttatcacagcttttccttggtattcctctatattatctgaggcgtctgcaacagatttctatgtgcctgatgattttattacccagcaagcggaagtaccagtaacttcctctatcgctccatcgactggacaggtaacacaacctcctgcaaccacagcctcttctttagagggtttaactaccgatctccccagtaacgcatcttccactattgtctccaatgtatccaccacaactgtgacagccttccaaagtgtaaatctaggctcaaaggctgataagtatgtccctctgttgatattggcgattttatgttacttgttttgataactcatcttttataagatcttcaattttttcgacctgacacaaacattattaccgttgttagtattctttagttcacttgttgttttctgatcggacttgatatttaaattcgataaataatcttcaataacatacccatttcatgaattcaggatccgcaagtttggatttaatttgacatactgtaggaacttcaagggttaactttgacgttggattttccagtttcaattcacccttatagtttttttctttggtgatgtcgttattctgttcctgttctttctcgatggaaggttcaggcgtctgttgagtgacgagattttgcatctgctcattaaacaaaggaactctcggtgctggtagtggagtactctgagataaaacaaaatccatgttggtggctgtttgaaggaagctctgttgtgaattttgccaatgcggatttttcacctgatgttgattgtaaaactgataattagctgaacaaacctgttgttcaggaggaaacgctgctgtttgatttgggttaaagaaaaaagattgcgatggtgataggacggtattgctccttgttgttactgctggcttcactacaaaccctagtttttgaaggatatcggttgcttgcacaaaatcaactccgttgtgaaatcctagttgaaatcttttcatcacaatagtattatcatctttctttatgagatatttgcacgatattgacggtgctttagctgaaaattgaaaaggttcatgattaaacccggcaaaggtactcttcaacgcaaagaaatctattacttctaaatcctgtaagtacggctgtgtcactactctcataaggagtttatttgggctcgtattcgaaaacattaagttgatcctaccatctgaagatacgtgattccatttatctaccaatgttggcgtctttccgctatcgaatccacttggtgctgcttctaaagtggtgtagtaagaatattttctaatgggaatactaaattctgccattttccttgttctgtattttaaccgccgaaggtcctttgtatcaataatacatccaaagtaatgttccacagatattatttttacagagaaagaagaataataaatgattgttcaggagtcagttttagggttttggtaaatcctgggtacttactctctgatgtgtatgtcgtcagttgttctttcgtgaacatgggtcactgaacttattagaggaagtaatcttaaaaaatgaaccggtgttttgttgttgttttttttttaatgatttccaggaacttgaagtttgacagaaactgacgaacagttaattcctgtaatccaaataaacaagccaactgcagatcaagttcccatttcacattcagctattttgtgcactatcaatagaatcagtttctgccacgccatacctcattgatataaaatcgaagcttacatttagagaaagaaggatggtgtatttctatacttcacagcaggttgacggtatgagtccgcattggatcattacaggaaaggataagtttgaaaacgacttattgataaagtacgggtacagggagttacgataccaatggtttcatgccgataagtactccagtgggcacatttatttgaagttaaaacctgatgagaagacactgcaggatgtacctcgagaagtacttcaggactgtttgcaattgtgtaagtcagaatccattcagggaaacaagctgccgcagtgtactattttatccacgccatggcataatctgcggaaaagcgggtacatgaagcctggtgaagtttcctataagtcaacgaaagctgttcgtaaaatggactgttttgctagagataatacgatattgaatagattacagaagacaagaattgaaattattgacgaaatagaatcgcttttgcatgaggcaaagaaatcaaaagatccagatttctttgctagatatattgaaatcaacagagagaggctaatacaagaggaaactcagaggaaagccttgaagaaacagaaaaagaagctaaagaaaaaagatgaaggacaattatttgagtatgaaaacattgaggtgttgtgaaatagtttttaagataagccaaccgcagcccacccttgataggtacattgcctatttagtatacctttcacaactgacacatggaagaacatatttacgtatcacgtgaccacatgatttctttttccaatattgaaaattttattgaaacgatgcgatgagatgatcaaacactacatagtaaggaatctataagtaagttatgtaccagtattgatctattggcaaaagttgctggccttgattgaatcagtgacaaactgtacttcaatagaacaattccaggatgtccaagagaactgcttccgatgaaggactagaaaacgtcgatgatcgaattgtccattctaagacagaggctggtgaagtaccatcggccaatgcagtgaatgccaatgagcaagatgttgaaatgggtgaattcgaggacccttatggtgatgatttcgagagtgatggcgaaatcatcgaaattgacgatgaagaagataatgaagaagaattagatggaaacattgagaacgatgagtttctggaaaagaagcaacaacaagctcaagagctagtcgaaaaggatcaaaatgctgaacaagagcaaagtgaacaattgtggttgccacatttatctaagcctttgggtcctgatgaagttttggaagctgatcctacagtctacgaaatgttacatacagttaacgttccttggccatgtatgacgcttgacgttattccagacacactaggatccggccgcagaaattatccacaatctcttttgatggcaacagcaacacaagcttctaaaaagaaccaaaacgaattgatggttttgaagatgtcccaattggctaaaactttagtaaaggaagacgaagatgagaacgaaggtgaagatgaggatgaggatggcacggaccctgtcattgagaatgaaaacatttcccttaaggacactaccaatagattgaaagtgtctccttttgccaatgcagctcaagaggtattgtgtagcactatgtctgaaaatggggaagtatatatttttgatctggcttctcaggtgaaagcctttgagactcctggataccaaatcccaaagcaagccaaaagacccatccatactgtaagaaatcatgggagtgtcgaaggttacgctaatgattggtctccaattataaaaactggtgcaatgctatcgggtgattgctctggccaagtcttcttaactcaaagacatacttccaagtggattactgataaacaagcctttacggttgctaataataaatctatcgaagacttgcaatggtctcgtacagaatcgactgtattcgcttcgtgtggtattgacggatatatcagaatttgggacactcgttctaaaaaacacaagccagccatttcggttaaggcgtcaaatacagatgtaaatgttataagttggagtgagaagattggatacctacttgctagtggtgatgatgacggtacttggggtgtatgggatttaagacagtttactccacaaaatgcatccactgcctccccagtggcacagtatcaattccacaaaggtgcaattacttcaattagtttcaatccactcgatgaatctataattgctgtcgcatccgaagacaacaccgttactctatgggatttgtctgttgaagctgatgatgaagaaattaagcaacaagctgctgaaactaaagaattacaacaaattcctccccaattgttattcgtacattggcaaaaggaagttaaggatgtaaaatggcataaacaaattcctggctgtttggtaagtacaggaactgatgggttaaacgtctggaaaaccatcagtgtgtaataaactccgtttttattattattatttacaaattaaatcctcttaatctttactcgctcgcatgtaagttaataaaacagataaaatggacaaattttctcctctcgactacatttggagttgatgtgactcatcgtttagaacacttcatttattcttttagttactgttgtatgtctttattcacaatttggtaatagcttaaatagtagtcgaaatcaaagatacgaaaaaacatcatgatctacagttttcattctttatgttgaaggataaacaggacatgaaggtaaggggcaattgaggctaaacagaagacttatagacgatgatgctcccagtaaaaccaccgcaatcatttcaacttcccggacgttgtatagagggtatcgatgaggatatcattcaaacaattgaggcacctaattcaaaccacttcctttttattacaaagacaagactttttgtttaccaagccaaaccctttgctccattagcatgtcacgaacgtactgctgagtctattgaactgtttggtgtcaattttggtattagagataatttacctcttggcactgaggtaaagggtttccttacaggccaattttgcgatccagtaatagatgataagcggttctactatgttataaccaagaacaactttctgttggtttacgaattatacaccaaaacatctgaaaatagcgtgttcaaagaatatggcataccgttaaacttgccgtcagatgattctttacttcatagagctcttgatgatgatatggatgatgaggtattgacagttttttctgctaaggaaaatcataaggttatacagaacggttatacaatctccaaacaaaaaggcttcttgcagtttatgaaaaatgatgatatagctgaagagttaccgattcgcaggacggaattgaaattaaacgtggtgctaaaatttgaccatcaaattttcgatgttattggtataattacgcatgatatagagcgtactgagcatgctaatcaatacctcttggtactttttgaacatgggctgcaagtattgaagcttgaggacttcaagctaattgacaataagctaatacatgtaattaacggtaaaaagctaatttactgtgctggtgaaattttagtgttatcttacgatgagcagcaactatctctagagcatatccttttcgatcaggaaaatgtgaaatctcaaaatatagcattgaagggcccatccggtgtttttaaagatttagtaatgtttgaccatttgcttgtagttgcgtttgagaaatgtaccatttactacgacgtctttgataagattttagtcagtgaatatccggccataacacacgtttcttgcatttcagccatttctcccgatactatggtattgttgaccgaaaacaactcagttatctttatgagtaagtggggaaatatattattatcaatcccaatcgatgagagccaattcaaaatcctgcattgctcgcttatagataccaagctattaataagtggatcgaatggtactctacagctttgggatctttggaaaaagttagacagttctctctccaatttcagaacaagtcaagtcttcactttactcaatgataacaatgatatactactttactctcctatgagtgattccacaaatacgagcacttttcaaacaattaagttaccgactaaaacagttaacaacaacattagtacctgtaagacaaatgggattttgacgttaatggcagtgtatgtaggtaacaaagatattttgctcatcaatttcttgaactccaacacatggataagttttgaccaaatgaatatcaagaatatcgattggcttggggacgactatttgctatgccatgtcacagatgaggattctgataaagaaatggtaaagtgctaccatttcccattactgaatgatggatcgacgaatcttgaagatttcaagacttgggaatgggaggtacctcaaggctaccagttggataatttctatgcgaacactttgtcgacatacaagatgttaaaattcactgatgaaagggaggacagagatgatgccagcaaaaaggtgtttgttacatcggagatactgatggttctttcgaattcgcatatgatcatattcgatgcactaagttcggtacatccaactggagttaacatggttcagaaatttcatcagtatgcagagtataatttcccagaaaattccttacgcggtttaaaatggatatacagatataaagaagggtttattgcatggattcgagatcaattggtaattattggccaacaagaggataagcaatggcgattccaagtagcatacgatcgggtggaacagatcttggagatatatgaggacaatcttgtactacttagtggcaacgaagtattattatacgattttgctcacatatggaccgtcgatgatcccctaatcactacaccggtcatcgaagaagagtatccgatttcaatttcattagatacagcaacgctgcataatatttcatgcattacaacacaaaagttaacgaaactctcaatatcacacggtgtgtacttagataagattgtggaccggaacttgacactaggcgtggaaggcgataaaattgatgagaagtatcatgatttgaagcactacaaattttgtttggaaaaaattctatccagtaaagtattggaacatgaggacttgaactccatattatcattaatcgatacctatgataaaaattcaggcgggattaagaatgaagttggtaaacttgaaatcgtagggaattgtttaagaaagatcgaaacaaaacattgggactacttatttgagaatctaaaactaactccaagagatcttatcaccaagtgcattgctctatctgaagcgaagatcttgggtacgcttttgatggtattcttaaactatgacgagggcgatagtgaatctaaacaggaagaggtcacgacaaagtccacaaaacgaaagaacaagaacaacaagaacaagaacaacaaaaacaagaacaagaacaagaacaaggaaaagagccatacaaacggactcaaggaatctgatagtagagagacttctccagatactagtgtatccaccatcctaaaagacgaaacagtcataggtcaagtcctcaagatattcgtatccactgccactctttcaactacaaaagagcaagcacaagagtattgggatttcgctctacaactaattcgattcttaagagcactagacagtaagggaaatactacactagcacagacttgtctggacatgatctaattaatactgggaaataccttttttctaaccgcacttgtcacgtgatactcggccaatcacaaggactgcatcgtcaaagacgattacattcaaaccccatataaaatatgtatgctcacactattcaaatcaaacatctcgtgccataataagaagatgatgcgttttcttgctgaatggaaaagtgttaccatcatatactgcgattttttcgcaattaaccaggtattttacagttacgcttttaattgaacgaagcatatgtactcctttctctggtactacacagctgtatactagggtagatgtaatattcaattgaccccttttacgctggatatatactagtaatattactattaaagtctatgtctgcggagtatctgtttgtgctacctcttcttaatgttacgatatttcatcttttttttttttttcattcctaatgaaattttcgaatgatattttcatagtttttcttgaagccgaaaaaaagattttgattattctaactttctatttagtttaactgattagtttttagaattaaaataaagaagtttaagaactattcttttcaattcttgttgttatttttgttttgagttttagttttagattagtttgagatttgtttgttcattcttattcaaagatattttagttttgtattgattttgttcaggttaattaagatcactctttgttcaaacatcatcaccgataaaccctattacaatggctgaaaatcaagaatctccattacacaccgttggtttcgacgctagattcccaaaccaaaaccaaacaaagcactgctggcaatcgtacgtggattaccacaagtgtatcaatgctaagggtgaagacttcgctccatgcaaggttttctggaagacctactcctctctatgtccagttgactgggttgaaaagtgggatgaacaaagatcccagggtatctttgctggtgacattaacccataaactggttggaaatatgtgatataatgcgatgaaaaaagaggcagttaattagtgaagaactagtttaggaaaactaaaaacaaaaaaagatgatattcatttggagcaagatgtgacaacagatactgaaattatctgttatgattcgtacttaacgtatcttcctcttttattattttcattcactttcctcgaacaatggcttcactgttttctgtcccatcgatttttcattcattttctttttaaaacaatatatttattatcccattcacatccgtcctccgtttcccctttcgatgttattgtcactttgtaacgttttccactcaatataagtttcagcgtcttggatcatcattccagaccttagtgtggaaattaagtaacattgatggagatccggaaatcccagtacaagtttcacttttattaaaacaatactctcataaaaaaaatttacaaagaaagatcaatttagaacacagtttaaactttgttacgtacccacacatcaaaacagtgatgaaaatacattctaatatcattcaggagccaaatacatatatttacttatattattttttttttaaaatccaagtcctattatatttcagtactgttctacatccagataccgttacaacggatacgccattcttcgagctccattaacctgtagctagaaaagcacgaatcatgtttcgttgtgtttggcattacagagaatttgacaaatctcggaaactaataatttgatactgaagacatgagcatgctatggcagtagatgatgctcatcaaatgtatatacctgatagtcttgactaacaatcgtgtcggggcaaatggcgcagttggtagcgcgcttcccttgcaaggaagaggtcatcggttcgactccggttttgtccacttattttttttccaatccaaaacctgacagtagcatgggtacgcaaggtggaatttaagagagggatagtccatcatacagagtgtcgtttgctcaatcaaatatttacagcactatatcttaagatgccgctactgctgaaataatagggcctccaatgatttaaaatttggtaaaacatactgtctgctgtttaattgtactacatcagtgactgcatcagattcttgtaatataacctctgaatggtgtaacactttcctcagagataaatcatcttctgataactcctttttgcaaacatcaggagttgttatgtcgaagtaaccgaatgagtttgatctatctacaagaattccatttactccagcttggaaagctcctcccagatccgttttctcctcatcaccaacatgccagacgtgtggccgaatattttccaagttctcacgttgaccactagtgttgtggcgtttcaacatatgagagaccgcgtaattaaacatagccgggtcgggtttttttatctcaagatcataagacagatagatatttccgtcgaaatatttcttaagatctaaattctctaacaacgtaaggacaatggggtcagtattactgacgatccccaaagaaacctcaggatggttcctcctcattgtctccaaaaattccctgacgtctgggtataccgtataggcagcatcgccctcgaacctttctaagatttcttctaccatttcatttggtatctgtattggttcaaacatatccctaattagatactcccaccattgttcagccgtgataccagaatttttaccatataaaggatactttttacggatattactgaaaacccctggaaatctcttagtgagttcttgtggattaccattaatcccgtacttggcacccactatacaatactgttccattacaggttttttgatggaataaagagtattatatgcatcaaacgttatgatttttggccgcgagtgctgcaaactgccatttttgagtacctctctaggaattcttaccggtaccatatttccccggttagattaacgttacttgacttcaatctactactctgaaatcgagagcttttctatgttttatttcttttaatggttcaacttggtatacatttttcagaaaaagcttggtcgaatgtactctgaagttcatcaacttagatctgacatataaatacagaaagcagatatacaataaaaagatgccttaaaaaggagtagagattctgcccagggataaatattgtaaagtcgctgtatgaataataggtttcattgttggctgtttgaaaatagcacttcaacaaaccgtgttattgataatcctgtctcggcggttaaacagctgatagagaattcgatagacgccaattgtactaaagtgctgatcaaaatagatgaatctagcggcggatgtaggtacatccaattgaatgatgatggtaacggaataagtgtccagaagcgcagcagcgtttttgttaaacacttcaaaactgacggtaaatcatgcaaaagaatagggtacaaaggaagagcgttatataatattggcaaaacagcatcgaagaagggatctatcgaggtgataacacggactatttcagagaatgttgctgttaaatggtcaccacctagaatcagaataaatgaaactattagattttccaaggtagtgaatccaccgggtacgacagttattctcagagacctaatgacgggaagtaaaagcagtagactggcaaagaaagataaaaattatattaaaatgattagggatatgctttttcatttttctttgattcataagcatatatgttttagttgccagcttgtcaatcctctaagggacggaagtatcaagactttagaatatgttgcgcggtttggtaaatatgaagaccggatgtcgcaattcaaaaaacatgttaccaaacagaatcttatagttgagttcgaacactttgatgagatagagctaagtgaatctctaaaagttaatatcatattgcccaaaattcgaacacatggcagagtgacagaattgatgccgaatcttaaatatccttgcattaatggagaagcagtaatggtacaatcaggctttggtaaaaaagtcaatcattttttcaaggaattttataagcatttcgggaaaccagaaccgagggcatggttcattcaatttttatgccaccatactagcgacaatgctgtagtcaatggcgaaaataaagctgtcgcacttacactggaaaaagctctatctattttgcaatgttcactgctcaccttctacgctccacacatgcagtataatgatccttcaaattctacccatattgatagtgaatcagtgattttcactcgtagaataattaatacaagtgacattccaaagcaaattcaccggcaaataaccaataaccctactcaacaaattctcgagaaggaatctgaatggttgacagacatgtatagcggcacgctatccgatggtagatcttcaccagtaagggaaaaccttctatattctgacattgtgaacaccgaggattgctgcattgagcgagatcttgaagacgtagagctatccagaaatacgactctttcaaatccatttattctttctcggatccgtgccaggaacactacagagatagttgacgatcaaattaaaagttcgggcatactagaaacatactatcagaggcagacgcaatcttctgagttttttcaagaaccaacaagcaagagaagaagaattttggaaaatgatccagaatatgaccattcaacaacccttgttgatattgagcatacagcaaccaacagctctactaaaaacctcgacttacagtttgaacatactttcaatctcggatgtcgcaaagctgtcggccgaagcgttccatggaagcttcgtttcttgaaaaatgcctataagaaggaattggtctggttccacaggagcggcatgccctcattacctttattggatggaatacaaacgctaatggaaggcgaagatagtgatgtagatttacagctaattcttatgccaacaggttggtttatgatagccctatagttcaccactttgaaggatcaaatgagttttaagatggttatttattatacaatgaaatcaaatttcaatccaacaacgcacgattcttagctgcgcagaaggcgtctgacacttctaaagcttcatatgtaccttgtagactggtcacaactctgtactcgtaagtatagatatcggaaactttgtgtgtttcaacaatttgttgctttctgccctttttggtgccagagttttcagtacggacgtaggttaatgcgaaaggaggtgtaccttcgaaggagaatataacttcagctttgtcaccttcatgaatatcttcaacaatctcttggccttgtgatactgttaccgacggaattggatgtatattcaaagataacctttcaaagtcttgtttcatcttcggatttgtgaaatctactacacattgtgatgaagaatcctggattgaaaaaatagatataacgccgggctcagatgcatatctgacgaactgagaggaacgttccttggattttagctgcttaccattgaagtcgtactttattatgaatggaggtgtcccactcaattggtatccaacgtaatccccaacacaatattccatggtagagtctgctagggatatcctaggaacgtctgttattgatattgaaatctgattaccactcgaagataggtcattgatacaaccgtttgcatcagtaacactatcaatgcttactaaatgatttcccaacgagaggccatcatacaatcgtttgtaatcaaagttagcagccgtaatattatgcatggtgaaagaatctgttttcgaagaactttcgtgataaatactgaacgaaacagagaaaggagctgagccatgaggcaccttcagtttgatatcctgcattagctttgattgctctatgtttgcggagcaggttctgtaggtgcttcctttctctaagaattctatttctggaagtgagtttacattctgtcttatcgaaagttgagaaggtttgtacgcaagtttttggaggtcagccttcccataattggaatcatatacattcttaatctttatcacatattcaccaacgacttcattagggaatttaattgaagcatacttcgtagcaacttgcactgaagatgagataagctctcctaacggtgaaatcatatcatattctatcaaaaagggtggtatgccgtttagagacatatcgatggtttcttcaaacccttggcagacatcatttttaatgtagttgaaatcgtccagttttgagattctgttgtgctcaattaatgagtacgtaggttttttgagataacttacttggaaagtatggttcggatctacgatcttgccaacacaactctggtcacgaattgaagccaatttatacaaaccttccttcataacctttaaggccggtttatagttggaactgaaagtcacctcttcagtttcgagaacgtctcccttgttatccaaatggctataggtgattctgaaaggtccttcacctgaaagttttaatggaagttctgcgaatgaagcttctttaatgctgacttgggaggaagattctgacacagcaaaagaagcagaaggaatatctcttctaacggtaattctggcatcagtaccacttagacctaccaaacatccactggaatccttcacagaaactaaagataggatatgatcaccaccaatgttgaaattaggtgtttcgatctcataggaaaaactttgaatattctctttattaaacgaagttctcttattagaagaagtctctactaaatcatagtttaacgtgaaaggaggctcaccactgaatttaataggtaccttcgttttccctccaagacataattttgtctctagcttccctgaaatctttgcactaggtttcactctcatgctggttttgaatgtgtactctttcgaatctaaggagataggagatgtgaaaagttcatttgacaattcggtgaaaacaatttcataactgccttctgatgtgggtgaataagtaaactggtttctggttccttgggagctgaatttttttgtatcatatagtttacgttctccttgctcagttttgtatatttttgttttgtagtaaaagggaggaacaccggtaaaagtaagatcaaaattcaagccgacctgtccaacacattgatctaatattggggttgatcttacagataattgaggaggaattggtttagttatcagaacattagattttccaatcacggcaccgtggcaatacctcgattttactgagagcaaattataagaacctggctcatcaactttgaattctaatgttttatcattgaattgtttttcgaagtatctcactttggagttgttatcttcatgggataactgaacgatgaatggagcatccttgttaaaatcgccagagtccaatttgactattaaagaccttctaacagaactgtcgggattcattttttcatccaaagatactcttggtaagtcgtgcacgtagaatctgtggatcaaatcatacttttctcttacttgtgatgataatgaggaaaaatcaatgctattaccaaatccatccacaattctttcgatagagtaaacatgttcaccgtattctttggttgaagtttctaatgcgatatctacagggtacgaacgagcccattttaaatcttggacatctttttgactgtagaattttgaattcgttagcaaaggtgattcaaaatattctggttgaagtgatgaatcttctagtacgtatctttggccattgattgtcttagtataagtcaatttaagaggtggagcaccttgtacctgaattgaaacctcatcattatctccaacacatctatcattttctccctttccgttaatggaagccaatgggcagtgaggtagcactaattgggatttgtatattctcaaattgatattattagtgtctagaacggttttcaactggtaaaacccgattttgttaagaggtacagtaaagtaatgtatgttacgatcagtttcttcctttgaaatatctgccttgagtggttttaaatcgttcttggtgaagttccacagttcaccttcatttgagtatagatctctgaactctaactggactgtattgattgtggatgatgagttgactcttataggtagttcaatggcaggaccagattggtccagtggtagacaaaaagacgagtggaagggattcaaatatgctgtattttctggcaaaattttaatggtatgtgcacctttgaagtgttctgccgaattcatagcctttcttgggttgacagagtcacctgttaaggacaagtctctgctgtgatactgtctccataatgacaatagaagcgataccaatgggatactttgttcactggagataaacagtgtgagggttgcggatgaaataatctgcaaaagcactatcagtggtttgaactttaatttgggtattttgaacgtggggagacagtaaaagaacaaagagtctattaccaaatattttgaaatgaagtttaaccttgaattcgatagaaaaatcccagataatggtatcccactcttaagtaggattagatcgtatagtttgtagcattgaatgataaaaaaaacgacgaaggctaatcttctctgactggctgcatcgagaacttcagtagaaatcaaaggtagctccttaatcgattcactcgctgggccattctttgctctactagtgcttgacttcgattttcctgtgtaattggaaaaaccggatatacaaaatggatcttcttttggtttgttgatctcttcatttcttcgatcgcttattcctcctctgaacgagtctttatctctatttccaacgttcctacgcctactatcactccacatcgatggagtatgtgtatagaacccatttgttccgaaactggaatccattatctaactgtatatgcgtctgaacttatctcagcttcccttttcaacagaatatgattctaaagtgccaatacgcagaagtttaatagaaaaaaatgggatcacgcatacaacttatcacttagtcgctcgctttttaattgacgattggtatgtaacgggtgcctggatcgcgattgcttgttgatcctagcctgcatctgcatacatgagaagaccaaacataagcttaaagtttgaacttctgtttgttgacaagatctgaatcggatatatcattatgtacgattcaggtttcgcttctgatcaaggtacaatggtcaaggacgcagcaactctatatgatctgccactacgttgtggtcttaatattcgaattatagcctcttgaattcttcgcctatccagaattaccagtgagatcgtttgcatcgatattataatgtcgattccgttgcatagctccattgcttacgtcaaattcccgtcaaattcccgtcatcctctcataaaaccctagtcagaagcaaggaggacataaatgctagtaagcaaatgtctttaccccatctggctaatgaatcctgaattaggtaagttttatcatgacctcatctgataaaaacctcggcaaatttgaatgccagattcagtaatagtaatgatagctaagggtcctaacatatataatatatatatttaccagagagaaaaagaatgttttggttggaatcgagatacttccattgtccaggatcgtctccttttttgaatcacaactggagcactggaacttatttgttttcaacaccatatacagctctcacgttcgtcgtatataacattacagaggtgcatttgaatctccttctataaaagaagtttagaaatttaaggttttgatttatttgatttgcactcttacaaataagtcatttacgagaagagagtttgctaaaacacgatacgttagaatctgtaagagtttgaggcgctagctcaatagaggtcagatattctgtgttgtaaattggtgatagttctgctgttttcattctctgtttattggaatttagataaaggaacgaaagacggtaatttattcttggcacgttactgttggtacttaaagattatctaaactgtgaaactgccatgcttatactatctcgtgtattcgagaggaaccatgttgaaattttgaggaagtttatgaagtttgtcggacctgggatcatggtcagtgttgcatacatggaccctgggaactattctactagtgtgtcaggtggtgcacaatttaaatacaaattgttgttcatcacattcatttcaaacatatttgcgattgtcttgcaatgcctctgcatcaagctaggtacaatcactggtttggatttagctgaaaactgccgtcgtcatttttcaaagcgtgttaattatattctatacgggtttgcagaagttgcaattatcgcaacagacttggcggaagtgattggtgctgccgttgcattaaatatcttgtttaacattcccttgttatggggtgtgctgttgaccgtttttgatgtgttgctgatacttctgttttacaggccagatgaacattccatgaaacgggtccgggcgttcgaaacttttgttgggattttagttggagcgacagttatttgtttcgctattgaattgttcaagatatccgtaccaagcaagttagaggtgttcaaaggcttcattccaaatcccatcatcttcaaagaacaacaagcgatgtatatctctttaggtattcttggtgctactgtgatgcctcattccttatttttgggttcctctctcgtaaaaccaagggttttcgattacgacttaaaaaaatacggtaaaattaaggaacaaccttcagtaggtgccattgagtacacgttgcgatattcgtacgctgaattgatagtgtcgttgtttttcatcgccactttcgtcaatgctgccattttaatagtcgctggtgcgactttatatgggcaacccgatgcagaggatgctgatttactctctatttatgaattattgtcccattatgtgtctccagctgctgggctcgtatttgcattggcaatgctctttagtggtcaatcagcaggtgtcatttgtaccatggcaggtcaaattgtatcagaagggtttttagagtggtcacttgaaccttgggtgactcgtctattgacaaggttgatagccatcgtaccctgtttcttagttacggctttcttgggagaaaagggggtatctagtattctaaacttgagtcaagtggttctctcattgattttaccaatcgtttctgctcctttgatttacttcactatgaatcataaaattatgaccgttgtggatgtggattctgcacccgcatctgcagacagtactgaagaaagtagattattatcgaaaggcgttaagtccattgactacaccaatggaagactgttgagcatcagttcatttgttatatggttgacaattggttcattgaattgttatcttgtattttcatacctcatgggagcggacgtgcatttttaagtctaagtaggcattttatatagttttgatggattctgtttaatctataatcaattcgtaaattgtacttattggatctgctttgttgatctcttctcttgtacctttgttgtggttaatttctttgttctttatataatctttaattgttcttggacatttaccttcgaaagtaattgaggaagtaaaaaaatcgaaacactgatggtttcagaaaataactccaaataatagtaaccgttagctatcactgataataaactagccccacagattattgcacactaccacagctgcgatttatagattctatacggaaatatctacttcactgcataactttcttacttttcttttttctagtcgatatggtcttgacgacaggaactgatccggcataattagtctgaaggactgggaaatgtttctcgtgcaattttggagatgtcacaatctgtttagaaagtagagcttctttcaagatgttctgtgctctatgataaagggaaacttcctcacttgttggttttgatatcttgttcagcttgacccttctcgatttacatgcctttagctttagcaatatctctgtcaataacctttgctgttcaccttgctcaaaagccgttatatcttcatcatgtatctcatggctaggttgccagtcataaagatttttcaaattaatattgacaggtccagctggctccgttgtcactattacttcatctccctcctcatttgtatcttgctcttcatccgtggcaacattctgctcttcatcattttcatttgattcctttttttggttgtcagatccgatactgtcatttgcttcctcaaccttttgatcttcaataccctcatcctttattttttcatcttcaacatttttatcttctgcttccgcagcccctctcttcttcgattctatttctaaccagcttttgtatccgaccttttccaaccatatgtctcctttacgggaacaatctgttacagacttgaactccgagatactcggagcaaaagattgatagtcgccatactccaaccatttagtagtgggtagcgggtaccaattcggatgcagaaaggaggtcatgatttctgtaggagaaattgttggatcaggaacattggaagtgttagctgctacgaatcccaatctattggctggttgggatgttgcttgaggaataattttcacaatttcacattcctcgtatggtacttcctttggcctctgatcaagtactgacctcgttatcaccgaactgaacaaatgtccctcctttgtctgcgtatggtaagtttcagtaacggggagctgataaacttgactaattttaaggaaatcattggaaatggtttttgaaaaatcactttctttgaagtcaatgtctgccgcgaagtctcccaccagtttggctccaactctataacattcccttagaatcaattctgctgcaaatttgtagaatttgtcgaccatttggtacgacctcgttccttgagagtagtagtgaattaaaatggagcatactaatttaatatcatggtaaatccgataaacagaatcttcatgcttctggtaatctccactagcaaatttatcagatatggaaattgaatcaatatcttctgctattttgatatctggattttcatcaaacttggcccttagaaacttcacgtaagaatcgtatatgtgtgttggatcaggctcgtagaattctttaggaaacctttcatctaaagctctgcatttcgaagatgcactaattaaatcaaaataaaattaatactgttagtatttgattgtaaaataaaatcatgctttggcaaatctaacactgaaaacataaaataaagacttgaggaaccccaggtcatcgtatgctggtctttaatttattattatcaccgattctagacaaaaacatgtgcgaatgcaacataattcgaatgaaaaatgtgttgtttttatattcacatacccttttaaaacagttagtaagttctgaaaaaaattctcttttagcagctctaccattgtttacttatttttagcccactataaaagagtttgcagaccttgtactctctcactgcccatcagtttgtcattcagcagtaatgtaagaagcctttattgatcaacctgcgccaaaacctgtgttttcattatgaaaaacatcaaaaccgtacatcatgatccaactggcatccattgacagcttttacagagattcctgtcacagcaacagtacccagtcatagcctaacaagctaggtattggcctttaattattccaatgcaattggtattatatgagttaattaattctataaattgtactggtgtagttctagggtcttttcgaagcttgatagtttttaaatgcttttggagtaaggaatttcttgaccgtccatacacctttctctttctcttgatgaacagggataggattgagttcccaaccaatcttgatgtcgctatcattgcaagatccaaatctaggaacaacatagcagaatctttctgttggcgataaatcaataggtttcaaaccttgtccagtgattggttttccgtaagtgagtaacgagccctttcttgcaacgttagccaatggcgtgcttttaatgtcacaaagagacttcatccttgttttcgccttttcattatttttattgacatgtagtgattggaaaaccaagtatttcggaggttgctcgccagaattgttgagaattgaggttggatgaatataaacaaagatatcatccaaagaagatgttttctcagcaaggactggaacataagggatattgaaaatgttggttttgttgatagtaacgtcttccgggaataactggtctgcgcgaacggccacctggtcgataaatcctgctgtgatcatttgcttgagtaatttgatttgaacatcggtggggatcgagctcttcaagtcttcgtctttaacatttacagctacattttctctcgaagtaactgacctgatgatgaacatcacctgctttctcaacttcataatctcctctacggtttttgcccttaagaaatttttttccatgaaagaactgtgctgatcctttggaatgaaatccaacgcagatactgcacttaaaagacggaaaacatcactgaatttatcaagcttactaaatctaattttgcttttaacatacttggagcgcaatagcctttttctttcctcagcttcgtgatcaggatagtcatctaattgtccttcatcttgtgtcttgggcacagtatccatgataccaagctcttgttcagataaaaacggctcacctactgaaagggcactgacaatggtaacaacatatttcaaacagtcgctttcattaccaacaagcagcattttagaaaatcttggacttagcggaaacaaactcattgctttaccatcatcagtgattctttcattactgtcgagtgcacctaggtgttgtaagagctttattgacttcatcaaagctggtctttcgggtggggtagggaatggaaaattcacaatattatgaacagccatgctcttcatttgcaaaactatactctccacaggcattcttaaaatttcaggcttagaaaactgctcaaaatctctttcgaaaactgcagaggagtataaacgataacaatgaccaggccctgtacgccctgctctaccacttctttggccagcagaagctttgctaatccagtcaatttcgaaactctgaacaccattattttcatcaaactttctttcctttgatctaccacaatcaacgacgtatcttactcccggtatggtcaatgatgtttctgccacattagtagcaacaacacataatctggagtttggtgggggatcaaggaagaccttcatttgctctttggtgggcaatagcgagtaaagaggaagaacatatagtggatctctatccgtctgaccttcttcaagtgtttcttcaaaaccttcttcttcgtcctcttctttgtcctcaatatcttcctcatcagagagtaaacaatcgtcaaattcttgttcctctctaactctgacactgaagtcgatatcttcagcttctacatctgcagttttggcatctattttcactgtaggtatgtggtcattttgaatgagagtttgatgtttcttggggaaaggaaactcttttcttaacctttttaccatgtgcgtgatctcttgctgtcctgtcataaaaaccaagatagcaccaggaggcaacctttgatgtattttacacgtcttcctgaaagcctcttcagcatagttataagctgttctacgattgaaatgtacagccactggatactgcctggcgtcgacctttaagacaggtggagaaacagggaataaagtagggttttcactaaaatctgatactctcaaggtggcagacatgataattagtttaagttttttgtacttagccggatcagttgcatgctccttagcacgtaagctgacacaacgacttaacataccaatcaaaatatctgtattgatgttcctctcgtgagcttcatcgataatgatagaagagtatttagaaagtctaaaatcgttcatcatctctcttagcaaaacaccatcagtcataaatttcattcttgttttatccttggtagaagaatcgaaccgaatttggtatcctacatattcgccatgatcacccatctcattagtaacacgtccagccatagagacagcggccactcttctaggttgtgttattccaatcatcccaggcgtgtcagttgaggacgaattaccatatcctgcctcgtaaagaaactgcggtacctgtgtcgttttacctgaaccagtttcaccacaaatgattacaacgtcattatgatggatagcttccataattctatgttcctcggcgaaaacaggtagtgcgcttctcacagcttgaacagcatcagatctccgtaccttgacataaaaagccttacgtgttgaattttcgttcacattaaattcatctgctttgagtccatcttcaaagtcttcaggtctctcggtcctatcgaccttgatgttggaggaaggcataaccatttctacatctctaccttcaagctttttaatttcctgatttgcccactctttaaattcttgggcaactgaagaacttacgtttctgcactgcgctatttctgaatccgatctttcctcgccgtcagactcactcgactcatcatcgctgtgactatcagcattactattagattcactctcatcaggttcactttctgcagtggatgaatgttcttctgattcactttcgtcagattcaaaatcctgatcatcatccagtttacgccttctacgttcttcttgctctaccttttgcttccagttataccttttcttcgaggcccttttattcaccacctttgcattaccgaatccaaaaccaaaacctgacccaccaaatttactgggtctattatcaataaatcccccagtatttgccgaaatagggtgatctgaactggtatggtccgtttcatcactatccgaattgcaattttcagctgtgctttcctgactgggcctagtttctggatgatcttgataccaatcccttacctcagtttcatcgtaaagaatttccctggtagtttcatcaccacgtccatttctttctaatttgagggcttcttcaatcccttgcctcttagtttgccttccttgtcccaaaatcttagaacttgtcaaaagcttagtatcaattttatagtcctgaagtttttctatcaaaacttttttctcctctcttttcaattgatgctcgatgaacttctctaacctttttttcttcgtcctagagaccttcgtttccttaggtgtgaatagctcttccaatttacgctttttctcttgtttctcttcctccgtcatgggtttcaatacagcagcgttcgtatcttcctgatgatcgggtgattcatgatgttcatcttcagatgaattaccttcttcagaatcagcatcggaagaattttcaagtgcacgggtgaactgcctattccttactctcttcaactccttcaacttagacatctgacccgcgcgtgctttctcattccagcgcttcctataggtacccatgtttgttgttcaattttttgaccgtttaacgtgcgaggtacttctcttgactgttaatgtcacagaggcctataacattcagactaccagcctgttatcaacgagattttgatatatagatgcaggtgagcttggatgcgatgagatgcgatgagctttaaagctttttctgccataaaggaagatgaaaaaaaaaaaaagaaagtcgctttcaacgttttgataattcaaagatataggcaatcttttgtacatttaagttcaaagagcagttgattccaccgttaattgggttttcaagtactcattaaatttgggaaacgtgataaatcgcattttttgcctcttttcaaatcattaatgaatggttcccaaacctgataagcacaacagctcaacagaggatgaagaaatatatggtattcttgacaagcctaatattaggcacgtccaatttggcttgaataaaagatttgcaacttggtacgggagtaatgtttattttggaagaaataagaggaccttgggcttcaaggaatcgaacaatgagcacaccgcaaaacaaagccctactgaaaagaagtttgaagatcagtattggattgataccctatacgtatgtgaatattgtttcaagtacactgatgatgaagcagagttaatcgcacatgagtgcttttgccgatataagaataagccacccggtagaataaaatacagaagccccgaatacactatacgaagggtaaaaggttctaagcatgaagttttctgccaatgcttatgtctatttactaagctatttcttgataacaagtctgtctacttcaaagttaagcatttcgaattctatattgtgtatgagaacaattctacagtaccgatggcatttttttcaaaagacttatattcctaccaccaaaataaccttgcatgtattcttgtctttccgccctatcaaagaagaagattgggtactctcttgattgagttttcctacactttatcaagatgtcagggtctgatttcgggtcctgaagttcctctatctcctttcggtttaattggctatcttaaattttggtctttctcaatagtttggcagttgactgaaggtaatttgaaagatgtggcccaggtcactttgaaggatctttccgaggccactggttttagaatcaatgatataattcaagctctcaaatatcttgattgtttaagtgattctgaaataagactcaatatcatccgttcatgggcaagacgcaacaaggtatcccatggatttatgatcaaagatgaatatctactacttgatgattaacgaattaaataacagcttaaatgcaaagccctaaaaggcttctatatgattgaatgtcatgatagtctattgaaacaacatttggatttcctcgatcctcttctgtctcctttctgcctcatcaccctcaacaatatcccctaacattctctttctttcctgtattcttaacattttctcttctacactattatcgataatgaaccggacaactttgacagtttgctgctgaccaatacgatgtattctatcaatcgcttgatcttccatacctggagaccaccatgggtccatcataaacgctcttgatgcacaagtcaaatttaatcccacacctccagttttcaacgacaaaagtaataactttatacaactcaaatccttatcgtggaactgttccaagattctagtccgttccttcatatctaaccgtccgtcgaatttgtaaataattacctgatctcttggcaaatgcgaacgtagctctatttctagaatgtctaggaatgatgagaactgagaaaatacgattatttgttcaccaggagaagtttcttgtatttgcttgagatgcctcaataaagctttaattttagtcgattggaaatgtgaatgaaacgaaattagttcatatcctctttcagcatcaattggctcctttagctttaacacattagcttctgagatcggcattctacaatatggacagttgatggatagttttttattttgctgaaattcaatgtattctgccaaacaaggttcacaaaatgtgtggagacactctgttatagagaccgcagacagcggttcaatacactcagtggtgcaaatagcacattcaaaagaaggtaattgctctgaagcgctgtgaatatcacgaaagttcgcacttaaagcatccaatttatcttgagaaatggaactttttggtgacttaatattttttggcatgaggatggaggagatgttttgagttgagttctccagatcttcaagatctgggtctccgagatctggtgtctttttgagtaaatccaaatgacagcagacttgtctaagtcttaaaatatggaccaagatattagtgtagttcttcaatagatcacctttggccaacccttctttaacagagttttccgcatcttctaacatggattgataaactcttttctcactggatgaaagttgcaacttttcgacgattacttcctttggaggtaaagagactaaaggtttgccatcaacatccttcatattcttcgttcttctgagaagcacaggctccaatactgcatttatgacatcaaatgcctgcgcatagttacctttctcgaaaggaactgaaacgtaacgcttccaatagttgatgtgagaccagggctctaagttcaagaactgaactaaggaaaatagatcgtcaagtcgattgatgattggtgttcctgtcaagatccattttctggaactccgcaaggctatgacagctttagatgtccttgtacttctatttctaatcgtatgaccttcatccaatattattctaaagaagaccacattgaataatcccgatgttgaggttctcccatattcgctctgaattatcccataagtagttatgattactgagggagcgttggggccaagcacatacgcccttaaatctttaatattattcccgtaataaatttcacaacgttttttgaggtccttgttggccttttcgaattctgattgccactgattcaataaggacatcggcactactatcaacgtcgtcctgtaagcataagtgtcatgcttatgttgagaatggcgtaatggagaggaatccacttgagaagacatctccttcatagaaggctttttggttgactcaattttcttttcatgagcctcatcatagctagcagtacaaatcaatgctaaagctgatattgttttccctagacccatctcatccgccaaaatacctccattgattatcgtcttaatgaccggcttctcgatagaaaactcaccagtgtataaattagcataaaagaagcaatcatcttcgtggtttggagtcccttgttttgaattagatggccagcggaatttcttccatagtggattcatactattcccatcaatagacacttctgcggctttctctgataaatgactatactcgtattctcttttgagcatccatgacaaactttgcttttggtaccttctcaattgcaatttaaaaagtgattcatctggggtagtttctggtaagttttgcaatgaggccgcggactgtgtaattctgtaaaatgattttagttgattgatgttcaaagcttcatcctgaaactgggaactagaaacagtgttttcttggtagttaggtatcatctcatttttggtgtctccgtacactggttgtatatttatcgcatcaaacaatgccattatcgctccggcgcgatgcaactgacgtgtgtccatgccatggtcattgataaaagatttgttcagaatacttccgccttcaatgcggacgaaagcctgtgaggtcaaataacaatcaattctgatgtaaatattatctccaacactgaatctcttaccattattaatgagaagatatggctccagactgacctgttcgctgtagtctaaaagtgggtacaatattcttgcaacatcttcaggcattcgaccaagttctctatcctgtgaggtatcgattaagcgaactaaatgcgaacagtgctggtgctgaagtgatttacctaagggaagatccttcggtacagattttttaaaacctaaacgggatccgataggaactggttttacggttggccgtgtagcgaatcccatagtatgaatagacccaatgtaacgagaccatcggttccttcccttgtcagatgacataggtgattctaaacctgcttgggtgctggtcctcttatttgtaaacagttgggataattgggacgaagacggcagaatagacaattcgtcatcattttcttcatccgacaaatctatcacctctatattatcaccagccggcattttagattcagttttacttttggaaagtaattccttgtcctcaaagaatttatcagctgcaatacttataccatctttgagcagaccatatgaactccaaagagtgtggagttgagaggacgaaatcatattttctccaagaatctccttcaaagattcaaaaaacctttccttatgattagatgtattacttgatacttctgaggaactttcaacatgtccttggccatcatcagaatcatctgcctcatcctgtacaaaaagagatcgagattcgttcaaatttattacagattcatcttcatcacgaaagaaccttggtttttcatcagctttttgcggctgtgtcatactttgggtgcccgtattgctagaatcaggtcaactgaaagatatatatgggtagtgttccaagtattcctttgctgtgcctgaaatgattagtaaagagatgagctgagatgagacgcgaataagttaacaatttcttaatgcaaaacaaacgcacgtgacgcgtaaatgaataaagtttttgtgaataaaaaaaacttcgaacttgaaaacttccagaaaataccacgttgtggaaacataatggaaataagaaacaaaatagaaacaaaagagaaatcggttcgtattcctatgaagtaccacaagctgaaatttcaaagcatcgaaacaatttcatttcccaatgtcagacaataaaagtatagagagagagagagaaagaacttggattctatatgagttttagtgctaacaatcccgaaaagatcggacttaactctggataactgaaaatagcggggttctgcggggtttaagttcaattactaccagagaagactgtaatccaggactgtttccatccaatacttatctccgtttagaagtacgttttcgacacactgtgtgagattatatgttatattataactgttatagagatgagttggaatggtaacaagttggtataaaatatggtatcataccacgcaggtgatattcatccttttatttgttggtttttctgttgttgttcctttagattgtattgtgcaagcgtcagactctagcaacgatgcagttaatacctttattgtggtcggtgcagctgttgtattagtggtatttgggatttctattagttttgctcgtgtattgatctttcgaagatcattacaagatataccgaagaaatacattccagtaactgcgcaggatatgcgtcataaaccttcaagggaatatgtgattgaaaatatgaagagagctggagaattggcggaaaagtttaaagtaccgaaagagcctgtcttacatgctggcatggaaccaaaagacagtgatatgtttcctgaacacttgaaatatgcggaaattgttaaatttatctctgataggtttagattcgacggggctttgctgttgaattttgtcactgaatcggatctcagtacaactttcaaaacagcacttcataaacttttcgagaatgaaaaacacccttataagcagtatttggatgagtttatctcgctttatgagaaattccgatttagtggacaagatattgaacgaaacgatttcgtaaaattcttaagactctacaaatatctcgctgatttatcgaataatttggatttaacaagaatcgagtctgtcccatcccaatttcttcacgttcctactgaagattatgacactgatgccagatctagaacggactccgaattctcaactccatatttacgaccttacccgtctgacgccttcatgcataatacaacccctgcatcacatgtgggctctcgctccagtaacttcagttacgatatagatgagtctgcagaaccaccagaatctgtggaagaccaacaaagatatcatgacatgctcactagagtagacacttacaataccgtcatacatagatgattaaaataccggacagtttctgtaacttattaattaaagcttttggacttaataattataaacaacaacgactcttatcttatataatacacaacgatgcagaaaggcatcaaaaaagagaacatgactaggagggtatcattagcaaacaacccatcgtatcgagaactttgatgtcaattcgaaatcaatatacctggatataagctggcaagtagttctggttcacgctcataattctgaaacttccgaaatccatctgttcaattgttgcttggtgggttcatgtggcacgccttgtaatacatcattgatgaacttttccgtcagaacgctaaactcatccgagtattttctgagcacactctttaagaaacccataattgcttcgtatttccacgcaaggtctaatgatggtaactcttcgtctgttgcctgaatgtcttgatcaagatctggaacaacaattggatcaatagtgttcaattgcgacaatacctcgttagcagcacccaccaacctgttgaagacatactcaaaagaaccaacatctttgtcagcagccatagccagctcattcaaaattctgaaaatagactcaatagaagtagagtcgacgagactcatgtttactccacactgttcggtcaaagaaaagtttaaaactgattcatttgaaattagaccattatatctcaaagagtccaaaatcaagtaaccagtttgagagttactattccagtatctgacaaccgcctcacaaatccattgatctttaatttgcggcgacacctctacctgtgccataattgctttcaactcttctctcgaatcatcaatatatttgtttgcatgggagagagatctactaccacagaaaacaatggtttgaatcagaagagtcacagtaaatctattgaaatcttcaataattgacccatggtttacagcaatgtccttgagaataccctccaactctgcaacagatctggtgtcaggttgcttgtggaagaaatccaaaagttgagttacgttttcatggaatgggaaagatggagatctgaaatatagctcattgttacgaagatcgccttcatccaattggaaatctttgaaaagagaggagtaatagttaacaagatcttctctcttgatgaaagatggatccatgaatttttggaattcatcagtaacactttcttcaacatcagcagaattggacgttaatcttaattcctttctgatcaaattcttaatgaatatcattcttggattgtaaatagttctattccactgaatggaatcaacttcccactcattccatttccatgagaaattgaagttactcatttgaattgagaaccaatctaggaacctagcttttaactcgaagtctagtttatccaaattgttatagaaatatctgaaagctctaccgaaaacaggagcaatagcttttggcgagttcttgcaaatttctaccaaaagagaatagaaataggcaaaagattgagaaacagtaggtaatttaaaagttaattctaagatggcaccaacggctaaatcttcgattttgaaagtacttcttgctgggttttcttcaaattgttccaagagttgggcgacaggaaggcccggttcagtgaaaatacccgcagtgaagaaaagatcaatcgttactaattgtctcgcaacttcaagtctattgaactccatactttcgattatatcaagaagaatatcttgaaataacatacctgtgaaggtggtagttggtatcacggtagaaaatggacccacactgttcggtaagtaaacctcgaatgaatatcttggagttttccatagactatcgactgaaccgaagcctttgtctaaacctgaaaatggaataatttgttctaaagttggtagattcaacggctcattaaaagaatgaattgctatttgttgggtcaataaggtgtcataattcaggaaaagctcgcctagttgttgcatatcgtttgccaatgcgttcttgacatttggcaagacagcagtaacccaatgaactggttcatatggtgggttcttattgtatgctttgagcaattgaatatcagtatctttaatgttatattcgttttcgacaaaagtgagtaactcctcaactaaagtttttaacgattcacgattatccgagttgaagtagaacaaatatggaacgttcaacaaggtgttggtatagatggcttcagaaagtggggatcttttctccgtggaattgtttaaatcgacggtaaactgcaataatttcttgtacaagtcaagcaaatcatctggtaccaccattggcgatagaatggagataaatctgagtactaacttaattttatcccatggtccaatatcatgagatttggtttggtagtcggggtcatgacttgaattaagtaactcttgaatttggtcaaagaaataattcaaaatacttttaccaatttctggtttagctgaatttagcaccatggttaaaagagcaatacctggttgcttatgaggttgttccaagataactgctctgaaagttttcaaaagtgcgttgttgaaatactcgtcattaccgaattcatgaacaatggcctcacttaggaacttgatatcttctggaaaagccttggccgattcacccatggtcctgatatcaggcatcatgtccttacaaagcatgacaacgggtggcagcctttgccttttggcaaaatgtggcctcgcttcacgataaccactctcttcttcataatctacaagaatcattgtgtttcagaaacagttgttagtaattatatgcttttccttggaaaacgttaatgtaagtctcagatatatatctgatactattgctttctctctgagttctaaaccaaagtgtcaaccaaccgactacttttaacgaaacttcttcgatattattcagagtaaatcataccgaaaacttgaagtatttataccgattgtcgatgggatgtctctctagtctagatgtgtgttttgtggcaatcttggaaccgtctgtcatctgtctctctttgctgacgtcgctgtcagttgtactaagggaaaacttaaatctgatataacaatacgtcagagatggatagaaccttcaaaaaacaatgcaaaactctaacgtcttgaatggtgacataaattaaacataccaaaacctctttttgacatctctcgggtacttgatggcgtattgttggatataatactgatatcagttggcaaaatcttgattgtaacgttatgaattcgtgttttcatatattttaattttttttcaattttcattttgaattcttgttatggagacgaccagacaatcaatgccattcgatacttaggccaacaggtacatagttgaaattgttaaagcttacgaatgtcagggtttcacagcctgtagattaccataattagataacaatgtgttttcaacgttttttaacatatatatgtatatttcccaaattatataggtatatgcttgactggaaaagaaatcgcagaaataacgagaccttcaaaatcggaacgaaccatacatggattcttttcattttgcttcaagaatcatgtacttgcttctgcaactgttctatcagtagatctttggactgcagttgcgtcttcagctcatttatttgaagggcgagttcgttaggagatggctttataccatgttggtataataaattctgttcttctgcaatgaaacgtttgagcctttcttcgttcaaattttgaatcaactcaacaatctttgacgattttttccttaattccgtttcgaaatccagtagagaaagagcctgaggtgactctggttccttcggattctttgattctaattcactttctaatctaccttcccttgcgatagactcggctaattccgtggaaaccaattgtagctcttgcatcaacatcatattttgtttcaaaatattcaaatactcttcagtgatcaacaggggttgtttgggatccttttcagaagcaaaagatggcttatatggcaacgcggaaataggttcagccttctgttttacatattctttctcaagacaaggcacttcctgtatctctgtgctttcaccaataatcatcgacttacgaatttgcaaagttgatctgtcaaatgtcttttccttattactatattggtcgtggtgattaccagcagatgacgcggaaaaaagagaatgatatgatattctacgtttatcgctggatgcacccgatttcgccctgaaagtatcatttaactggatttcggatccttcatctactgccatcgaactcctgctgcttctagcggacgaaggtacagtagtgagcggtctttgatcgccactcttcgtccttttgatcttcatcaaaaagttcttcgctttctggaaactgctgcctgatttcttcaagcctttttcaccagaacatgcgatataggaatcatgttttgattgtagtacttcgttagtattactattcccactgtcgaccgccgcatgggcttttgatacaattgattcagttctattgacgttgtcgccaaagtttcgactggaagagttgtccgagatttcaggatttaatattggtgatagatccacgggaatattttgtatcaaggcggtggatggcctgagatttatgtcatcattcaaagaatcttgctggttgcttttcgtttccgaggaatccactaggtcgtattccttttccgttttttcctcctcgatctgcaacacttgtcttgcgggttcacttaacgttaatatattcaatttcaccaatgaatcagaatcatattgctcatcgctatgtgaatgatccttattcccgctgtaggtttgttgatcttcttcttcctcgttaaagctaggaagagccttgtctttttcaaagtcctcattatcattcgacaaagtggcatgtagttggtatttcaccggtgatcttggcagtgatggtatctgattttgttcatcgaatgatgcgttcgagggagttgtcggagaactttgttcagaaaccctaccagaaatgacgctattcacactggcatatgaagaggatgagcccgatgccgccttattcaccagctgctgtggttgtggcggaggggctaatgagcttgttgcttgtctttcattgaatacattatcctgcgatacattttgttttggttgataaaatggttgcggatacgattgagtttgcagggacatggctcttggaccagagtttggaccatattgggagctaccagtaacaggtggacctcttgccggcactggtccattaacttgaccaggaaaacccatgttacgggatcctgttggtgacgcggcatacggaccttgataaccgtttctaaactgtgaatttccgttcatttgagttggtggacgtctgtcagcagttaacgacattgtgcgtgggtcatttggaggaccttgttggggaggataccctggtctaccagccatcggcgaagccccccctcccatcaaagagttgaatctgctaccgtttggaggcctagggattcttgattgctgagggcctgctggacccatcattgttcccgggccagaaacaccaggccttaccataggacgttgatgataattttgcaaggacattgttctaggaccacctggaactgaggcactgaactgcgcttgctgctgctgctgcttcgcaagactgttaaatgccattttcttttgattcatcataagttttctatattctatattgttcattgagtttgtgtttccggaagtcacgatggtcggtattattggagaggtatcatctagatgtccaccgtaaccgtatgcgtgcccaccattgtttctcatggaagaaatatcattgaatgtaaggaaagaggaatcatgatccgaaaagtctgtattatcgtcatcctcattagctttttcgtcatattgactgtgtctcttttgattgagtttcttgtatttacccttgaagaaattagagaaggaagcagtagaagaactcatggatgatttcctactactgtctcctgggtaatcaaaatgtggtcttggttgcatctgcagagattgttgtcgaggctgttgcatgtaattatatgacgaagggttgtaattggactcgtactgctgggcttgtaacggaactacaggtggggccatggggcctgtatttcccttctgcttgtttatctgctgctccttagtaatatcaatattccctatatcgctgtgaagtaactggttccgcagctgggccttggaagacatgcccgctccacgtcgttgatcaagcgcagtaacaccggcatccatattccacgatcagaaaaggttagaaataaagcacaacctacaagaaacgaaaagatggctagttgtaaaatgagctgcacttacgtatagaaaagttcctttaacaatgacaaacaaacaatctaaggacttacctctaagttgttatcaaaagtcctgatgtaccaaagaagcgttccaaaatcggtagggaataagtcaattacactcgtactgtggattggttcctctggattataaattctgccagaacctaggctaaatgactgtactagaaagagaatagataaaaggaaatacaacctattaatagtgactaagtccaaaactcaaactgattcctaaattgtttgaacagacctaagattcatttactttccgttcatatttttttttttttctcaaaacgaaatctgaatgccatagaagttccgagcgaacatgaaatgtatggattatgcatgaaacaataacgaagagtgaaaaaggaaacggaaggcagctatttaggatgtgcctttacacaacgttgtatataatagatcgtagtaatctgacgaaataatggcttctgcaacctttgtatttgaattaaattttatatggttcccaaatgttacaagtctatgcagtggttattgcgtttaaaaatgattttacttactgtccaatgtagtctaatcagaaagttgctcaggtgagagaatggtttatcaccagcttaagctcttcttgattttgttttcctttttttaggtgtagatgatggtttaggatcaggtttcgcaacaccctctagatttatctcttcagagggcttggaaggctcagtcttatcagtctttttagattcagctgtttgtagatcttcgttggtaacaagctttgtgttttgtaattcgtagatgaaccacgtcacggtgatccatagtagagtggcgataatcgttaatgcgatgaaatggatatttttggttaaatagatctgcgatcccaacacgcaaagcaatagtgcaaacgagatatgagtagcaatgatcaattgaggcgatgttcctggttggaaaatgctttcccacagtgcaacaacaaagttagtcattcttgagtgtctcaggtgaatttcgttttttatagtggttggcaacggaggattataatatgctgtactagaaatcgatgatgagcctggagtagaaatcagcaaggtatagccagaatgcaagtgaacaagcttgtaagtatgaaatgacgacttcctattctgatcgagccgggtgtattatgttatgtcactggcaaacgtatgtatatgtatagaagaattttacttttaaaactttaatatagagattttaagatacagattatgtatgtcaaacttataatttacagaccgataacagaggaataatgaagttaaagataaaatggaatagaaaagggaccacatcagagtactattggagaaactgatgattagggtgtccgatgcatggatgaatagtcaagtatgatctaggatcatgttggacatgatgacatttgtattgaaaaagatgggaaaataaagtgacagtctgtgtttttcatcgctgttcgattagataccagcgccgaagatgaaagaaccagccatcatcaaagcgaataggatactgtacttagagttgattgggttagcaaccatacctggagcagcattgtcagtggcagtgctgttatcacctgttactgcagcagtagaagaaccggtagcagaagcagaagaatcggaagtaatgaatcctgtagatgtggagccagtttcaccagagccagtagcactagaggtaccagaagcatcagaagcaccagattcaccggaggcagttgcactagaagtgccagaagcaccagtggcatcggaagcagaagcatcggaagcagaagcatcggaagcagaagcatcggaggcaccggaagcgtcagagccagtagagacagaggaaacgacaccagtagattcagcaccagagctcgtttcaatggtactggaaccaccgtttccaactaagccaacagcagaggaggcagatgaggaaacagaggaggcagcgacggcttgtgcttgtactagagagattgaggcaaaagacattattgtgttgttatattaatttggtggctagtgtgaatgaaactattgatcttgtatattgcagctgttaggagagagaacatataataatgaatatacgtataagccgagtttagatgagaaattgtgatcttaccagataacaaacgctccctttatatattagattcattcagcatcacaagaagctgtaatcgcttatggcttattaccaagtccaggcgtattgaactttaaattgcatgctgaactgccttgcttcgagaaatactgaatctggaatttcacttactactataggtaagaattgaaagacttatgaagtaagattctctcaccaacacacgttcgaagcatcgccaactagccaaaaaaacacaaaaatagctagaagaataataaaagctaaatatagaacagcctctgtttcaaacaaaggtaatttcttcaaattcttgtttagaatgtattcccaaactgctgaacctaaagaagctcagacattattcaagcacgaaatgccaaaattaaaaaaaaaaaaaatgataccaagcggtttagcctcttctccacgtattgctgccgcatgtgtctcgagattctaaattacatgcttgcttcaccggttatgggacaatgaaccgaatgagatcgctagatctgtaagtaccaccagagttaaaagcaaatgattacttaagtctcgatctggccaaatctggaaattcaaatacgaaaggaatctctggatcgcagtacgatccggaaaaaaaaaggacacgagagtaggagaacggacggactagattgggccaatcgatccaggggagctccgccccgaaacaaaattaaaccaagccaagcaagcgttcattatcttacgtgcttttctcacatgaccttaaaatcgaaagcaaccttaaaaccttaaagagcttctactaatagaaggaacctaaaatacgaaaatattgcatttcaagacatccgaagacgtaagaaaggaaaataaaaaagtggaggaaggatccattagactggagctagtgtaattagaactagaacaggacataaatagaagttggaaatatgacagtggaaagggtacgtaatacaaagtccggtttcacactaataatgagaaatcagtattggatctgagatcgaagcaagcttttatgctaatcgggggatattggactagcaccgccaattaaggatgccaggtaagacagcggactcttgaagttctcgaaattttctttcacgagcgagaatcacctattgtctcaaattatgcatatcattattatagtatatatgttgttcttttgagttacattaagttacattattttcaccactagtgatcgattgaattagaatggagggatgagtagtgggtaaacgagtgaaaaacctatcaaagaaggttcaattacaatagtagacttgaaacgaacagtagtgctgacatggcaaatcttggtctccagtgatggcctgcatttcctgattgtgtagcagaaagccctgtggaagacgaattagtggtagcggtaggttcttgggtagttgtgttttggtttatttctcctgttgctgcgataggcgacgacgaatctgttattagagaagaaggaagaagtagtgaggcagttcccgctgaaatttctattccactttcttgagctgtccctactgtaggtgtagacacaacaaacgtggatgcactaacgttaatgatctgtgatacatccaacgataggatagatgttccacctaaaacatctcctccgttggaaaatgcgtagctgacactagcggtctgtacttcaccatctaccttgattatatttgtaacggacatgaggttatttggatatttttgatgttattcttattgctatgatatggctgaaataatgctaatgagacaatttttgtgatgcctctgtgtcgttcgattgggcttgcgtgttgaatttcagacctatacttccaatctctttgagttttatacacttattccaaaatgtcaaatgtaaaacacttaccagacgtataatatatacaagagtcgattacgaactttctatttgtaggactgttgatatcactcaaattcttgacgctatatcaattttattccttttcttctccaacagtgatgtacggtttaccggtgaaacatactcactattcgaacaccgtttcaaggttcatttttaaagaaaaagaaacaagagcacacacatacacacacagaagaaggcaaaggccagaacaagttccaactgagccagacctcatcatccagggtgtgtaacatcatccggacctgcctatactacggattaatgcatggttgatccaaaaaagaagcaacaagtgcaggggtagtgatgtaaagacagtaaagataattgagatagtgagccagaacgtttgagatcataaccttttcgtctcgaatcactcccaagtaattcaagttagctgaagaaaaaacacataaggtggcttgcatacttacgaaatatgtagaatatacccaacaatctaatgttgttcttgatccaacgatcactttctcggccggagaccaatttgagcagccagctgctcttcgccggaaaaaagagctctaaaaagaaaaaccgttatttaacaaagagatcgaccaattttctgtgagacgacataattatgccttgtaaaagaaatactaaggaggaaccagtatctgcaagaagtcatacgcgaaacagcacttcaatcgaataacagagtatcatatcgaggctgagacgcgtcaaacatgcaacccaggattgtgttaaaggcataggttaccattcactctggacttaactttggcttcgtcacattaaaacacatcaacttttccctctggtacgtttcatgcacaattacgtttttttagtttatttttatgttcgaacctctttttctcggattcttgtagttgtatacgaattatgtttcgtggtaaatctacatgcgtcatttattaaaaagaaatgcaaacaaaagaatgctattacccggaatactaaaattatatcacgtgacgagtatttttttaaaaaaagtttactcttaaaatatgatcatcttgaacgaagaatgatgcgacgctagatttgagccaaattttttttttcaatcgttctttgtctgcatcgatgaaaaattttcctttctgcaagttttatataaactcatcaccttctttcaatactttttacctattcatttgtgttgttcgaattcatcatttgtttcaattcgttcttttatagcctccctcctcatcaactaaactacatatcgatcaatcaaagatgggtgcctacaagtatttggaagagttgcaaagaaagaagcaatctgatgtcttgagattcttgcaaagagtcagagtctgggaatacagacaaaagaacgtcattcaccgtgcttctagaccaactagaccagacaaggctagaagattgggttacaaggccaagcaaggtttcgttatctaccgtgtcagagttagacgtggtaacagaaagagacctgtgtctaagggtgctacttacggtaagccaaccaaccaaggtgtcaaccaattgaaataccaaagatctttgagagctactgctgaagaaagagttggtagaagagctgctaacttgagagtcttgaattcctactggattaaccaagattctacttacaagtacttcgaagttatcttagttgatccatctcacaaggccatcagaagagatgctaaatacaactggatctgtaaccctgttcacaagcaccgtgaagctagaggtttgactgccactggtaagaaatccagaggtatcaacaagggtcacaaattccacaacactcaagccggtagaagaaagacctggaagagacaaaacactttgtctttgtggagatacagaaaataatctggtggttcttaatcgaaaaaattcaatccttaatcattacaacaatatttacaattcttttcatttcatcccatctatcttcgcacgcatgtacggaaagtttgcaggtttatcaaaacaactctgcgtactttgactatataaaatatacctagtatatctgtcctagatagccccgaattaatatcattaaacctcctttttttttaacaaaagtgcaattgatccattagagctatgaataagccttacttgtggatagtatcgctatttaaagaatgttgatcagttgggacgatgctcttccgctatggtttacaggaatttttttaactctgtgattttctgacttgtggcaagtaattttttttactactaaaactatggagtcatactatacattttcatctcatcacgttgaaaagggagaatgcacgaaagtaaataggatactgagtatacagagaaggagacaggtacgtccagatagagtcgaacacttcgtagagcctacagaaaaaaaatacgcggtaagactctcttgcgctcttggaaactcaatgaaaaaataacttcaaagtaaaaaaaaataggaaattttcagtacaatgtaaaatgtgaaatgaatatctctaatcctcctaataaagtcaaaaaaaaaaaaatagaatcgaatttaaataaaagagtaattgatgaacttcccaacccttcaaataattgatataagggaagagtaacgcattgcaatccttatctggctgctctcttggtgttgatttagtactaagacactttgcttaattattcggctttgatcagaacggtttactaacagcaataaaggaataaatccaggttacaacctttttataacaaaagaagcgtgaatttatcttttaatttgagttaaacattattttctctggtagttgaacattcgataatatttgcactcatcaagttaccatgccacacactaagactgctattctctctgtctatgacaagacaggcttgttggatttggctaagggtctagctgaaaacaatgtcagaattttggcttctggtggtaccgctaagatggttcgtgaggctggattcccagtggatgatgtctcttccatcacccatgccccagaaatgttaggtggtagagtcaagactttgcatcctgctgttcatggtggtatcttggctagaaaccttgaatcagatgagaaagatttaaaggaacaaaacatcgacaaagtcgactttgttgtttgtaacttgtacccattcaaggaaaccgttgctaaagtgggtgtttccatcccagaagctgtcgaagaaattgacatcggtggtgtcactttgttgagagctgctgccaagaaccacgctagagttactatcctttctgacccaaaggattacccacagttcttaaacgaattgcaaaagggtgaaatttctagtgacttgagaaacaccttagccttgaaggctttcgaacacaccgctgactacgatactgctatctctgatttcttcagaaaacaatactcggagaacaagactcaattggccttaagatacggtgctaaccctcaccaaaaacctgctcaagctttcgtcacccaacaagaagaattgccattcaaggtcttgtctggttctccaggttacattaacttgttggatgctttgaactcttggccattggttaaggaattgtctgcatctctaaacttgccagctgctgcctctttcaagcacgtttccccagccggtgcagccgttggtttgccattatccgacgtcgaaaaacaaatctactttgttgctgatattgagaacttatctcccttggcttgtgcttatgcaagagcccgtggtgccgacagaatgtcctctttcggtgactggattgccttgtccaacatcgttgacgtcccaactgccaagatcatttctcgtgaagtctctgatggtgttattgctccagggtttgaaccagaagctctagaaattttgaagaagaagaagaatggtaagtactgtattttacaaattgatccaaactacactccagaagcattggaatccagacaagtctacggtgtcactctacagcaaaagagaaatgatgctattataaataaatcttccttcaaagagatcgtttctcaaaacaaggacttgccagaacaagcagttattgatttgaccgttgccacgatcgctctaaagtacacccaatccaactctgtttgctacgcaaagaacggtatggttgttggtttgggtgctggtcaacaatcaagaatccactgtactagattggcaggtgacaaggcagacaattggtggttaagacaacacccaagagtcctaggtttcaagtgggccaagggtgtcaagagaccagaaaagtccaatgccattgatttattcgtcactggtcaaattccaactgaagaaccagaaaaatcagagtatgaatcaaaattcgaaactattccagaacctttgactgccgaagaaaagaagtcgtggatgtctaagttgaccaatgttgctctatcttctgacgctttcttcccattcccagataacgtctacagagctgttagatccggtgtcaagtacattgctgctccaagcggttctgtgatggacaaggctgttttcggtgctgctgattccttcgatttggtttacgtcgaaaatccaatccgtttgttccatcattgaatggtgttgaattgattgtgtctttactcttttatttaacatctctttctattttcttaccattgaaaagtataaatcttaatatattagtatccataagtattacgaactgaaactttacgcaacatttccttccattgactgttcctaccaaactacggtttagcctaaatttgatatacaatgtttgggggaaggtaactcatcatgatacaggaccatgtcattttcatgaattaaatcagttagttgttcactgataattaaccaaattacgcactacatagacaagaaatatagaggtaattagagaattttatacaaaagatgtctgcagtatggttttacccaagtgataactggcccatagggcctacacagtgtttaggaatatactgcggtaaaatgacaacgagatgaccgagctcgatttgatacactttccggaaagaaaactcccatccagcacatcaaagaactcaaagtcatgcattctacttgctattaagatccgttgacggggctacttctgtctcatccatatacataatggcaacaaccaaagatgcgaaccattcagaatatccaaaactaggccacgactcagtaccctatttcgaaaaacagaggagaagtaggccctcttaatgaaaagaacgttaaggacactcagaagttgaacagtttgcagagcttagttccttgaaactctgcctctcgagcgtcaatcttgttagtctacataaacagaggttaagcagcaataacaaaggatcagctaattaaagttagagtcacctccctctgtccagcgtagctaacgcggatctatggttatttaagcaaataaatcaagaataatcaaaaatacgtacaattacagtgcggcttaaaattaatagttactagtagttgttaaagaaaattttatgttgatcgtttttatagtaatttttttctttcactttgagctcaatcgtcagacagtagagaaaaaaaacatcaacatcattacccggtgtaaagggctgtaatgatacatatcgttaacgcttaagggcatatctacataaacacatacatatctatacaccctcacactagtgtattagtctgaaattgatttcgattgatcaatattctaaacaatatttaatttgctgtacccagaaacttctctcctgcaacaaatgcaggtattgaatccacgaaggcccaaagacatcctacagttttcgcaaagggcaaaacatttacatggccatagaattatgtttcttgtgtttgtcttacaaacaacacatgcaagatctaccgcttcatcgtcagaatcctgatcatgcaaatgatgttcatgtatttcgtgtatctttggagaacgttctgacattacttcgcgtaatatgcctaattcgttgtttcttgcaaacctccgtctggtcaacattcgttcatttgtaacgttttcgtagttcagtatggcccacgtagaaaggtaccaactcatttcatttggcgaacggatcaattcctggatttgttctggattgaaaagttcttgtgccatagccaattgtctattatttatccttctttcttggccagctccgtgtatggggccttcggtatcggaatagaagtcatcatccacatcgttaaaattatcatcatactcgtcttcgtcatattcttccaactcatcatcgacatcctctatttcggtttccaaaggaacatagtcctctgtgtagtcctcttccggtaacaaaaatttgtcagtgtccttttcatcctttacatgaaggaatttgacatagttgttctccgtgacaaagtcattgaaatttcgttctggttcttcgagaatgttacggcccttgtttcccttccagaaatatttgaaccaacctataagatatttgaccatagtcacataccaagatattcttaatctccaaacagaagttgatcgaagatctcttctaaagtcgagttcctgtgctggtaccgcatcgaccttatttagatatccgcttatcaagtagcttttgtgtagtgatgtgggagttgtaacatcttcgaactctctgtgaataccattagttctcgcctgttttggattacagaggaacacggcaaactttaaggcgacagagtaaaaatcttcttcaccacttaagttcaaatacgtggtccaattttgccaaaatgaataaaattgtaactcttccactctacttgttgctccgaaacgtgaaccaaaatttcccatccttaccaaacaggatagcttatagcagagataagaaaggatgacgatactagtggataagatctttggaccatttttgaacacacgaaacacttgaaaggaccctataccagataaatttgaagtgaattgtaggtaaatcatatagacagaaaacggaacgttcaacaatgtagagaatataattctgtaatgcctaatattgaaaatttcaacaaaatgtatgataaatctacctaaaaggcatataatgcatgtgtatccgtatgaatcaactgttgcattagacttgcttagctgatagaacgcgctactcaactcgaaaagcgaataatctgattcttccaaaggctttaaatttgcggtggtagttatgaaagtttcaatgcaatgtgatagacatacaattccgtaacaaatggacatatacgaaccagctggttgttcctctccgtaaaatctaaactgagcaccaatttgtataagcgcgtatcctaaagataacaatgcaatcatatggaaagtgaccttcgcccaaggagccaattttaactgttgattcgttgacctcaaactggacatagccattaacctattcaaaataactgcaacaaacaagcaactagcagcatatccagaaaggaaatatgtaaccgacatccaaaagaaatcaggtgaagttgtgaagttttcgttcacctgaggttgttccacatgagcatgaactgaggcatagcgttgggcaatggatgaaacgaacgatctaaacgtttgatacggcacattaatagtctgagccaaaagtgacgtgctattgataagagtgtgagaagtttggtccagataaggaaactcggctagaatcgactgattaccgggcgtggttacattcgccatggcatgaacatataatagagcggttaatattaatattcaaatctaatgggtgaaaaaaacttaagaataatggaagcgtttttacaacttggaattgattattcaatgttctcccaaggtgatagttggatcaagcaaaccagtcgctggcaatttcagattggaattgtgtatctatattgaaggggattcagggacagaaatgtgcgaataggtatcttaactttgttgtcgaaaaaggagattcggatcaatataactattcagtacacgagagtgcggaccttaaaaactatacaaaagaactgaagaaatagttaaattgataattcttgcttcctttgcttggttaggttcacctcttagagaagatacatacgtagatgcccatattaattgtcgtaggtaagcctccagatactctgaggaaaatctcgtatacaatcaagacgagtggatccgggtaacagattatatttatcttaacaaagggaattaaaaaagaaatggttgcgaagagattcgaactcttgcatcttacgatacctgagtgttcccaactgtaaggttggttaagattggtatcttgaatcaggcgccttagaccgctcggccacacaaccatattaattgtaattgtacgaatgattgcttaagctgactatacctcagtggaaatgtcaggtatgcaaccgcgtttcggacattatccagtatcagagtttccgtctcaaattagaacctcttgcagactgctcagcttatatctatcgatactaagggaaagtatgtgtcatacaccccgtactctttatcgcaatagcctgccattcggaaattccaacttactctaatgagacgtacaaagtgatataaatttcctgccaattctgtcaccgtcatgatggttgagtcaaccgctttacggtgaaaaagaattgaattattgacttgatatatgtataaaattatcagctaaggcagtttatctttgttttggtcgaaggttcacacatctgcttcttcatacgtttatcattatcaagctttgattacttttataccaaaaccaattaacaacgcggtgcgggaaattgctgtcaaattgaagaagaattatgtccagaaccatacttaacaacatccaagaattgccaggcgatgctttattcgctatcaaacaacgtttagctgaagaccctagatctgctaaggtcgatttgggtattggtgcctatagagatgaggatggtaaaccatgggtattaccagctgttcgtaaagctgaaacattgatccattctgacgcatctttcaaccatgaatatttgggtattgccggtttacctgctttgacttcaggtgcagccaaagtgatcttgggcgatgattcatctgctttggctgagaaaagagttgtttctgctcagtctctatccggtactggtgccttacacattgcagctaaattcatccaaaagttcttacctgggaagttgttgtatgtttctgatccaacctgggctaaccatgtctctatctttgagtcacaaggtgtcaaaactgctacgtatccttactgggatgctgctaccaaatctttggatttggaaggatttatcaaggctatagaatcaagtccaagaggctccgtgttcttgcttcatgcttgtgctcataatccaactggtttggatccaaccgaagctcaatgggagaaaattctcagtgcctgtgtgaagaatgatatcatcccattgttcgactctgcctaccagggtttcgcatctggtagtctaacgaatgatgcttttgccgtcagacttggtgtgaagaaattcgctgaatctgctccaattttcatctgtcaatcatttgccaagaatgttggtatgtacggtgaacgttgtggatgcattcatttgattgttccaagacaagaatctaacgttaatgtttccactattaccaaagctgttgcatctcaaatcagtaaaatcaccagatcagaggtttctaaccctcctgcttacggtgccaagatcgttgccaaaattttgaacaatgctgaattgactgaacaatggcataaggatatggttacaatgtctcaaagaatcaccaaaatgagacactccttacgtgacaagttactcgagttacagactccaggtaactgggatcacatcgtcaaccaatgtggtatgttctcttacaccggtttaacaaagccaatggtggaaagattagaaaaagaacatggtgtatacatggttgctagtggtagagcttccattgctgggttgaatgaaaagaacgttgaacatgtggctaaggctattaatgaagtcgttcgtcatttcaatgaatcatccaaattataaacattcttatctcaaatctttgtagcatagcagaaagctgcaaatcgtatgcaaagaaaatgaacagtattccttcctataatatgtaatgtgatttatgtatacgctccttaagataattatcttcatactctctccgataaccgaacgtccagattcaacgtctttgaatatctgtatgtaaaacgtgctctcttatgaaaaggcttgacaacaaccctaagatactagctagcacggcaaaacctagtaccaacctactaccgccttggaaactaatttttgccagcgattctaagagtgggtcgaaggatacatcgaacgaattgttttccagtaatgtctggcaccactttctcaattggtgagttgagtatttatcattcaaggttttgttttctacaatgttacgcagaagagatgtctgtaatttggattgataaattaatccagcaaaagatacaccaagagttgagcctatagctctgaaggcatattgaatggaggtaacttgtgcttgatgtgaagtgtcaacactagcaattaaagataacagtgttattgttaacatactagcataacccaatccgggtaggaataacatgaagtactccaggagaccttttggttctgtgttataggtcgataagtaaacgataagagtacccgcaactgtcacagtgtttagtgtattggacagtgccttatatttgccggtacgcttcatataaagaccggtcatcatagaaccaatggcaataccgaaaaagttagagactgtcctgacaccaatattccagggtttcaaatgatatactgtttgccaaaaaacaggcacgtagtaggctaatacaaatgtactcatggtgaaaaaccaattggtcagactggaagctaagacagtacggttcgatcctagaagccttattggaaccataggattatgaactgatagttcagtggaaacaaaagtataccctgccagagccaaaccgacaatgaaaagggcccaggtaccgtaagttaaatgagagggattatccaatacggataaaatgatcattaataataacatggtagtgattaaagtaaaactaccagtgaaatccacatgttctcgcacatcggcagtggttatcttcttgttggacaaattaatgagcccacgacctggagaacccgcaggtaaattcaaaaacttcatgattaaggaacagcttaataacgaaagtggtacttggcataagaaagcccatctccacccgattctctgttgcaaaaatgcaccaatcaaactacccgaagcacatccaagagcaaatacaatatttcccataccttggtatacacctctctgtctcaatggaataatatcactagtagtgatagtactcaaactattcaagccaccaccacctacaccagcaataaatcttccaatacataacatccataagctcttcgtaaagggagcaccgcatagaatacatccgaatccaaaacacaaatttgaccatatcaacaatggtttcctcccaaagacgtcagataacttcccatacaacggctggaaagcagagcaggataataaatacgaggttgcaatccatgacatctgattggatgcatcaagttctgaagcaatcgtaggtaaaagagtagttacaatggtagtatcaagtgctgctagatatgatccaacaaataatgcgaatactatccaattaacatctctcagcggttctacgtttttgtcatgtgctgcttggtcaggaagctgtggcacgggtgataacaaaggctgcaattcatcagtcattagatgctggtttgatgacttattattcttcgtttggctgttgaacttcttgctggattagtatcttaatttgatacagggcatgtaaaaatcatatcaaatcgaatggctatgatatttataagtgaccaaagaagaaaatcggtttgtattttgatcttaattgcatctgtaaaaacaacgtccaactcggactgctcaaactccaatctaatcttatctgatctccctctctctttctctgcataagatgggtttaaaccaaaataataatcgccgtacaagtctcatgttcggcattcagcttgacacaatttcctatttgaggactgcaataccgagatcacgtgccttcagtcttcaactgactgaagattcatgttccgagacgttgaggttatctattggtttagcgagaaacaaatccatatgatcgttccaattctcagagacgcccatatcaaaggaaacacagtacttcttgtttttagatccaaaacccttttaacagccaaggtggacgagatttactctgaaagagaaagatgaaatgttgaactgtccagacaaacaaaaaataggaatttttcgaactgaaaaataaacacatacatacacacaagccaagcaatgaactgtggtgacaaagaaaggaagttttgagtacccatcaactgcatacaagtggtgtgctgaatttatttactgtattttaccattgatagaactgagtgtacttttttggggtaattcattgttaattccaatactaggcactaaaagtaaaaaagagtgcagaaacgtaaagggacggaagccaatataacctactcagtgacacgtaaagtagaacagagttaatcataatagaaaatatgtcagtcgatattcgaaatcgtactattgagttccagaaacgatgtgcgatcatatccaagaagaataaggccaataatgcgtctgttgcttcaaacaattcaataccaaacaaatctgagttccaaaaaaaagcatcagagatagcacatgagatcgcaaacacggctgtacagttgggcaagctatcacaattggcgaaacggaaaccgttattaaatgataaccctgttgagataatggaattgacgtttctcattaagcgtcgtatctacaccatcgagaacgaaataatggaattgaataaattacagattggcactaaacagcataaacagaacgtgatgacattgctcaataccaagatgaaaaacataagtgggaatttcaaggatgttttggagacaagacagaaattagagcttgagaatcaggatagattagaaagattgacgcatgttggtggatcagataacaaagattcaacaaacaatacatcttcattggtacctgcaggagccagcagcaacattataggacatggttacaataatgtgaatcccttcataagcaatttgattgacgatgagaccaacaatacatcttcttctgcgaataacggtcttacccttcccgccaacggtaatctattactattagaagaacaacaagatcagagatatctacaggaaagaagtaatgctattgaaaccattgagagtacgatacaggaagtcggtaatcttttccaacaattggctcatatggtacaagaacaaggagaaacgattcaaagaattgacgataatgtaggagacattgagatgaatattcatggagcgcagagagaattactaaaatattttgataatatcagtaataatagatggatggctgtgaaaatatttgcgattatatttgtatttttcttgttatgggttttagtaaactgaatactagaacgattatcattattcgtctttgaaatagattaatcacagttagtagtaatattatatagatactctatatcatacacatttaaaactattcaccggaaaggtaaggttaaatgacattcaatatatggtaatagggaaattaagggagagaaagataaaacgtataacatatgcacattttttgttttttctacaatcccatttcagcttgtagttctcttaatgcacgttcatcttcatcctcttcttcgtcttcctcatctgcttgggcactattaagttctggagtagataatttgacgtcgggtacagacggtaagtctattgaaggttgttgtatttgttgctgaggtacaggggcaatgtgttccttttgcaagttttccgattctagcagttccaactcctggtctaattcgtcctcgtccaactcatcttgtaatatcaacggtttagaaatagcctcgctgatttcttggtttagttcaacttgttctctgatttcatccatagtatcatccactttatctagatctagccccttatggatatttttcattgcagatgcaccttgtttcattgccttcaaagtttccaaattcaaattagcattttctatcgagtaaagttgttgatccaaagaatctatctgtgattgtagtttgtcaagctgtgattcataaagcttcttcttcttcaaataagtcttcgcattattcttattaccagattgaagacttttctttgcaagttgttgctgctgatctatctgtgtttgcaaatgcgcctgtttcttattcaatagttggatatgttctctaaggtcgacaatcgccttcttaggcagttctttctgttgtttggaagttccgaagaaatagccccacatgatgtgtctaatgtattcccgtcaaatctgagcctaatgccacagggtttaaaaaaatagaagatgttaaaattatacctgagattgccaggtgagtctatgaatatgagcccagcgcctcagtctatctttgatagtagctgttcttctttcttacttattgttaatccaatattgttcagttttttatccgttttaatttcacaatttcagataggataatcttttttgggggggggggggagactacggcggcgaacgggggagatgtgaaacttcattacccgaatttgaacattccagttccatatcacgtgatttatattgatcacgtgatagatcttttttcacattgtagtttcttcttctcgccaaaccagagaaactcactatgccccacctagtcaaaagggatgagttcatatcactccgaacggacctttccacgatccaagcagagcagttaccgcggggtagcaccggactaaagcagcaggaatggctccataccgtgagcaatgtatatactacatagcattggggccattatctaactgctaactgcatctggtcctggatgagtaatcagtcacagatccaaaagattccactatggctctcgcttcaatgctaaatcatgctcttcaacatttctctctcgtaagctcacaaagctggacctggtaagcttagtctgtaccccgtactatagccctgcgacaatttccccctatctgcccccctttctacgccctatcagctctttttttttttcctctgctttccctgcctgtgtaccttcggctcgggaacggaaaatgatagagtataattaaacacccatacaccactgtcaaattccctagacaatctcggagtgaacatggcaccgaggcatataaacatggaataaaacaatttattcactgtaattccattttccaagtttttttttttttctagtgtttccctgctttgatttacttgaatttttctacacatttcagttttggctatcatgtatatatgtggttattatagtgatcatcatatggacaaactttaactatagtgtcacttagaacccttgaggattgctaacactgtaaaaagggttcatctgttaagatactgttgtgtcaatactagacttatcatatacagtaaaatcggttgagagccaattttcgtggatagatcaaattatagatccattttggctattctcaattgaaagtaacgaataaagagttgggttaagtcattcccgtgccaaatatttattcgattggtggctgatcctctactataaactaattttatttttacctctcggtttctattacactgtgaacggattttctcggtggcctgcttctattccccataattttctggctttgaaactctttcgtttgatttatttaacctttcaatggatcagcagaggatcacacagcagactcctcaatggagcatacagagcggtgccagtgcacgtgctatgaaaagtgcgtcgcatgctaggcttacgaataaccagcaacagctggaaatcgaatacaagaccatgaaacaggaaaatgctaagttgaaagaggttataacgacgttaaagcaagaaattgacttatattccagagtaatgtcgaggaattcttctcaggttggtcctactacggcaacgataccgctgcagatggaaaccttacttgtgaatccaaaacgtaggaaaactatgtgtttgggaagcagtattaaaccttgaagcatttcctggctttttttttttgtgttccatatttatccggtagtttccttcactaggaagctgtctttccacaatcctctctttttcatttccttgtttctctctccaggatacgttgtttttcctgaattgatggaatagttaccagtttttctaaccccggcactcgactgatttcacgtttttatgctaatgatttattatgttctgtttttttttttcattcattcttatgggccccgccttcttaccctttactattaacttacgcatgatatcagtgacttaattagcagtttctcttccaccattttaaccctcggatggaaccactctggtctttttattttgattggcaaagcgttccaaaacctttttctatttggcaccagccagtctcacacccgttaatttataatttataaatgtcttatgtataacgaatctctcacgacctcactctaaatcgaatattcctttaccgtttttaatcaagaaaattgttattcattcaaaaaaaaaacatcgatgttccccttaaactgttcccctctgataaagaggataccgattgtaagaacggttctagtggtttaacttcgaatagcgatggctgaacatcggtcctacaatttttattctttattggaatgagtttattacgtttattatggatttcgtcttggctcagttcttttgtgaaacgcttaacatcggatatctatatatgtatatataatcacgaagaaaagtagaatcaaaagtctatcaatatgcatcatgcatgaagaagtgagaagaacagtaaatcaattggtaaattgttctagtttaagtcaggggagaaaaaaagaacatggtcttagtttaatttgtttcggttttattttaacatttgcatggtgacttcaaacgccgcgaaagtggcaccgttgacaggcaaagaccgaagcatggtaggcatgaaccccttggtgaacgctctcagaccacgctctctatagatgttttttgcgacttgtaccacgtttgttccgtaagctgggttaactaatttatcagcttgcataacggatttgacaacatcgaatgggtaagtcatagcccagaagaaagcaccggaaagagcaccaaacatacaagccttccaagcagatatatcttctctacggaagccatgggctaattgggacgctatcaaggtttcgtaagtcaagaaatagataccaaacccatgagaagtcctcatcaaagtagcagtaaatccacgcatcaaagatccttgtttcaacaacttttcagtgcagtccaaggtacttttatattctgcattcgctagagcctctttttgtaattgtaatctaattctgacatgttcaattggagtcgcgagtaatgcattagcggacccactaacgaacccacacgtataatattgaccaagggataatgtgttatcgtaaataccacgtgatctgttcaaatctctgaagtatctcttcatggcttcgttaataccgaactggcaagagacacaagcgccgacacccacaagtggagccatagttcctttatagaatcccataaatccttcgtatttgactaggtctgtgatcgcttcccaagcagttgcgttccctggcatagtttgtaaccgtactttgatgatatcaaatggttgccccactagaacttgagctaccccaccaacagtacctgaaaatacatcctttaaagttttccgaaacccatgcaaatcagtcaaatcttcgacgacttgaggagtgatcaataattcgtcagacataatattagtatattttagctacaaccactgttcttcaatggtatctcagtagatatcaagatttattaccgttcacctcatctcatctcagaaaacagctgcaaaaacagtgaagagtaaaaagaaaaaaagcagtactaaaatgtaaacaacatggatacaagagggatctatagaattcacttatatatatatatatctatatattaaacatgttcaatcttcaagcaaaccatatgagttaaaaagtaagagtaaacacccaacaaaagaggttagaactagcgaaagctgaataatcgctgcacatcgaataaaactcccggctacaagagataaagctaggacaatctgcgaataaccgaaagtagcatgaagacaagcaaagagcattagctcattatacacattaaatccataatacacaaaagagagaaattgaaacgcatagataaagttgtaataaatctaagcgcattcagaccctaaatggtttcacattgatatggatccagaatcggatatcaatagccgttgatacgcccagcactggctgtgaggcgttgctgtatataaaagatttccttttttttccttagaaacgttaacttcccatacaaaacttacttcagaaacaacttactcgaatcaggctaaggatgtgcttttactactacaaaataatggacctgtctttccagctgtcagagactccgtatgtttttgtggcacagacacaaaaaaaaaagaggtcttgagataaaaatcttggatttgcttcccgttctcatttttcagggggcgcatattaatttccgcttctgactctcgaggttgtttttacctcggtaggactttaatgtgcgcctatctcgatgatagccttgttttgatatgttttgttgtcgctcacgcatatgagccgattggaagattatattacccggataaagatcttgtccattagcggaagctcggttccatatgctggatttggagtaattttctcacagattgagtagagatggcgctctcattagagatcacgtgattcgatagattgtgtactcttaacctgataattgcatggaagtatagtccgacctgacaatttcatatctccaaagaagccatggttccactggttccactggttcggttcaactacaaaacaaattagacatctctcccatttaagaattattaaacaattatgctcaattgtagtactaaaagctcctatgtacgtttgttcagggtctctctctcattctataatgctcatcatgtagaaacccagcaatgtgcatccgatttgaatgacagtagttgtgatctcttttcgtcttgagttggtacttatatttagtaattctggtaccacgccaactgtgctcgtatagatgaaccctccacatgttataatcatgatcttgttggtccattcctcgttgttgagttcgtcattacctttgcccatttcatttaatatacatccgatggcagctccagtcaatgatcccaagcatgtaaatagctcagattcgatagcttgtttgaaagtcaacccactggatagttttacagcaaagtctcctaattcatgcggaacctcgtgaaatacaacggccatgaatgacattatcccaacgtattttgatgtgtagaacgatgaggatactgcgataccatcggcagccttgtgtataaattcagtaaccatattgagatacgtacttacctccaaagacttgttattggtcttgctcctggaactctgagtgccagtaggcttcttatcttcctctgtcgactgtttcaagtgatcatcgtcgaatgtgtgtgtgtgcgaatgtgagtgcgaatgtgagtttggactgcccatgttgatcaccctcagtagtttatcgatcgccatgaaggaaaggaacccatatagaattccatatccaatatcaacaggatcgccctcatggtatagctctggaagaacgtgtaaaaatacgtcccctaagattcctccaagagcgaatggaaccatgagtcgaaccattttagttccacctcttttgaaccccggtattatcgccaccaagatacacggaagagcacacaaatagagggtcgcgagcattgcattgtattttgccgagaatgggaacagcagttgcagatattgaattacggcaccgttgttcaattgttggaaactattctggtgtacgtgatcatgaccatgtgaagtaacatgatgacttgcatgtccatgtgcttgccttaatcccaggctaagtaccgttaatagtgctgcttggatcatagtagttttttactcccagagccactgcggttaaaaccaactgtaaggtgaaaaccgatcgttagtagtcgatgtttccattgttggttggctccatctaactatgattctttttctatcaaaatgatgatggtcgatcacgtgactcagatatgtctgttttttcccttaaatgaaaaacttaaatgagatcaaccaaaacctcgaggcattgacaccatcagtgtggatatttgagcatacttataataagctggctcttttgcttttacttggatatttgaattcataagaaataaatttccaccacctgatacaatgccattgaacgctgttagagttgcctcaaaggctcaacctgcaaagaacgtgattcttgtcttccatggcctaggtgactcaggttcgggttggagtttcctagctgaatacttgcaaagaagccctgcttttgcgcatacaaggtttgtgttccctaatgctccaaatatgagaatcgatgcgaatggaggtatgtctatgcctgcttggttcaatatttacgactgggcgaatccagatgccagagtagacgttgaagggattaaatcttctttgaaagtaattaacagtttcattcaagaacaaatcgatgatggtatctcacccgaaaacatcattcttggtgggttttcgcaaggcgctgcattgactttagctagtacggttacttctccttataaacttggtggtttctttgcactatcaggattctgtcgtttaaagaaagaagacttagattcaattgccgaaaataagaataaagatacaccagtgttccacggacatggagaccaggaccctattatcccaattcaatacggttcagacgctaagaagtttttcgaaaaatatttccatctgtcagattatgatttcaaatcatatagaggcatggctcactctacttctctagaagaaatgcaagatttggttcaatttttgagcaaagctttaaaactttgatatatcaatttcgtcaatagatgaagcttgaaacaagcttgagaaagcatagccttgaattaatgggctacattgtcattcaaagaaaactgttcttttttaaatataataattctgcctgtatttactagtcatatgcacctcaatgttttggcaagtatatcaatatagaggacgccgtggccaggtttagaggcgcatgctactctgctcttctatctgatcaacttgcattacattttacagtcacttctgacgtgtccgttgccattcattgggatttgactgtttggttaaagacacttttaatataataataacaaaatatataaaattataaggtttgaccaaagaatgatgcatcagtaccgagataaggaagaacatcaagacaaactgcccctctgaaacttgacttatcggcatagaaaaaaaacagccatgtcgttgccattgaggcccttgtctctagatgtgaacacaaagcagctagattctaaacagaagaagttccaccaggctgtggaaagggcattgcaacatttcgatgctgtcacggaatgggctgactatatcagcagcttaggaaagcttctcaaggctttacaaagttggtctcctaaattccagaatgttaaatactacgttccatatccttatcaggttgctagaagattgtcttcatcattatctccaaacttaccttcaggagttcatttgaaaacattagaggtttataattacatttttgagaagattgggcccgacactttggggaaggaagtgaatatttggataggtggcgttctacccttgatgtcttatgcgtccatatcggttaaacatccattgattgaactgtatgagaaatacattgtaagtctatcttctgttacgttgaaaattatagtgaaacctgtgttggcaagtttgttcccagggatcgacgacgaaagtagtgagtcgcaagcaagtaccataaatttgatagagactctttacactaatctagatgatccctctttattttggcaaacttctttcattattataatcaataataaagatagaagattgggcggtctagtgtggttgacgaaaaagttaccatcgttaaatgcagttcctcatttagctgcaaaggaaaaggacacagctttaactaaaaaggattcgaaggagaggaaagaatttgctttgtcgttgttactcgatgcctccaaaccagtagtttcacccgagccaggtttgctaataagatcttttgttagatgtcttgaagatgagaacgaaatcctaatccaaagaggtattttggacttacttttgcaaaggttgcatttgcattcaccattgttgcaagtgttagttaaaccttccgactgtcggctcttaatcatgacggcatgcagaacaatgttgaaaaaagacatgtctctcaatagaagaatatggaactggctgcttggaccagtactagatccagaatctggagatcatagcgattccgagtattttatcaagaacggtgctcaacatttgttaggcggattgcatgagatgctcgaacaccctcagacgtgcatcgatgcttacaaaatcgtgtctgcgttgatggatcgctggcaaattggatcttatttaacaccgaaaatattcatcccacttatcgagaaatgcagagagtactcggacaatcaattagtattgaaaacagcgtcttctttctttgattctgtcgaaactaatatcatttgggggaagcttttcgaaaaagtgttttgcgataatgactatgaccttctaatatatgtgctacaaaatttccgctgttccactgatgaagaaataacagtacgtcacttgccgctaattctactatcgttactatgtcagagttcgattgaaattccaaagtgtactcaaatattagaaattcttgtacgaatgatacctgaaagagcctacttgcccattcatcactcttctttatcccagggaagcacgctatcctatgagaaatgctttactgatatcaaatcttactatgaacaggtgtcagatcctcttaattccaaagatctaaattcgtcatctgatttaagtcctcctttcaatacggcagatctaacttttttaatcacttatagagtgcatttactgttgatcgaaaatattcgaagatatcaaaacataaatgatatttcgaaattgtttgtattattcattgaaataatccccgagcagtatgatgtatcagaagaagctgaagtggtgaagtggtcagatactgatttgatagagtgtatctttgaacaaaatgatgcaatcgaaagtgctcctgaacagtcactacaaggaattgttgagatttacactaaatatttgttccgtaatttaccgatattggattcgatgcgactattaaagataattatgaaagggctgtggtcattactcttagatcataataaacaaattgacgcagtcgaaatgctcaaagtcataacaagacatgttccatcgtcaagaattgaaagctgcttagcttctgtttatttgggggattgcgacattaacaatcgtctagttgttctagactgcctctggactcatctagcaggtaactttgatattataaaaagacctttgtccctagctttggacgaactttctgatgaaaagaattctaactactggtatgtgcatgaatgggtggtatctatcatttctggtgaatccggaaacaagttctttgaacttttggttgaaaacccccttcaatttgagtttataaataacgaaaagattggcaatatggacgatttggcgctatttacttatcatcttgatgttttgagaaatgttttaaaaaccccagacactgtggtctataaagctttcggaattcaattagtaactgaaaaattatccaaggactgggcggccgaagacgtatcgtcatataaaagcttggttattgctgtgctgctaaaatttctaagtatccaaaatgacgcacctggcaatagcataaaaagtgcattatctcttttaagtttgcttgtcaacggtactgaaataaatttcaagaacattgtgacgagattgctccaaatttctacggaatacattgccagtaaagttcctgattctcaagttgttgtcgtatctttgctacaaataatctcacaggtgctatctttatcggataaaagacaaattaagcttgacatctttaccgaggactcttcgcatatgaaatatgttgattttcttgtatctacagtaagtcatattgatgatgacttagtcttttcatcctatgtcaatttactttccgagagcattgcttacttccaagagtcaatcctcaagatcattttgcctttgtctgcatccatagttgactccatatctagactttttgaagacgagcagaaaaggggtaaaaacttgaggtctataactgctcttctaggatctttagaagaaattctagaagtgtcgcatggctatttgcaagctgatgaaagcaccggttatttctctcacaccaatgcaagaaatgattttttgcagaacatggtatccaatgtgttttcatcggatcaatcctcttctgaagcacgaattttaaatgagagaatggtcgttcttaaatcttttacaatggtaagcggcagaatatcagaaatgtggaattgggctgaccaaacagcatctggagacttgaggacggtcaataactcagagtttggccagtcattacacgaagtttcgacaaactacaaagttatctcaaataagctacttgaaaagcttttcctattagaaccatcagatattttggaatccttaatttcgaacccaattccttctcagctcgttagactaaatcactctttggataacggacggtgctcagtgacaatttcccgtttgctacaaggtatagtaacgagatgtaatgagactagctctgtgtctttattcagcagtcatagaagcaaaaagaaccttaactctgcagagacaaatcaccttggcgcgggggatttattatcatatttgctcaaatattttgactcgttggataattcggcagttgaagacttttattcagattttatggttttcttaaaggaagttttgagtaactatactagctatagttcaatatcgtttccgttattgcaattaattgccttaatcagcgaaaaacttgactactctagtttgggtcaagaacgccgagtcagaaaggaaataactgaatcatttattaagttactaaacaatagtctcagctcggatattatggatagcaacaataaagaagacattatagcagctttgtattttgttgttgagaggctttcatatgttgtcaatgaagttaatcaaggtgataagttcaacagcactttgacctccattgttatctattccatagtgccttacagcaaaaggatagcagaaatctcccccgatgtattgcacttcatgaatttgatagcaccaatcggagagagagttaaaccttggaaattattccttaacgaatttttcacggattctaaaacgttacgggcgctgttagagacagatgacaaatcttggagtttcatattttaccactggtctctatactacgatagcaaggagaaacttcttccagatctaatattgtccgtaacggcgaagtcgaatgttattacaccttcaatcaatccgtttaacacatggagtgattcagaagttcaatccaaatttaacaatattctacgcattgcgtatttggttctcatttctccgaaagatcattattatattcactgtcaatcacttttgaacattgttgaacatttcatctttggagtagagaatgcattacaagccgctggatatatattattacgggctttactattgaaatttacaaacacacatttcgctgatcattggtcgatgttattctcaggtttacaatcatctttactcacaatatatgaagctatacaagttcaacaatccattgacagtaatgttgtccttcaagtatcgaagactcttgatcttcttctaaccgttaacgtagaagaattttctgccactcatgagtggttattcgtcattgacactattaatagtatttacaagaaggatccttatgtcgcgctagtagacgagataagccaatgtaaagatttggtaatggtcacgacgtcgggtgttacactgaatgaagatactacattccgtgttcccttgctagtcaacatacattccattgacagcgttgtaaacctcattcctttcttcttcaatctcagttacgatcactatgaagcgatgtacaacttaaaccccttgaacgaacaggtatgtattgatgatttatcgcatgacatttgtcatcaattcattaagtgatcttcaataaatattttcatttaagcaatgagaagctcacatttgcgttcatcagtttctataaaatttataaacacttaatacttcccaccctgcttttctgtgtatcactaattcacttttccatccgctgaacttcatcttacttgccacagtttcaggtttatttctagcacaaaacaatatgtacgctactccgttgcagctaagaattctgtccaatccattcaatagtctctgtgtgaccaccatcccatcatcaccaccatccaatgctagaaagagccactcatcatcacgaacagcatgatttgaatgaggcagttctggtacagtttctgcaggtacatatggtggattaaagacaagcaggtcgacctcattttcccttattgaagacgtaaggtctgtttgtaatacatcaaaatggctattcttgcaaccattcttcgaacaagtgtctaaggtagcgtccaatgcccaagggttcaaatcagttgccaaataaagtccattggcgtttggtataccattttgcataagaaacgtagagactatcccagaaccagaaccaatttctatagtcaatggtactgcgtcattgaacctgttattcaaccaactcagatcagcttctaatgcatctaataaaagaaaagagtcctcgcttggctcgtatactttattataatcataagagacgtatggtgtagctagcatcgccctgttatcctaagccctgatgagctatagctcgcatcaatatctgttctgcacctgtatcttttcaaacatggaagtcatcgcatatataatattgtatttgaaaagttgatattgaacaataacgtatgcaaaaggtcatctaaaagaaagtaattaaattgaagcttaacaactagtctactgtttgatacaactattaatcaccattttcagagaatcgacaatcagttgcttgtttgtggttgagaaagatgcaattaaaggtcaagacattaacagggaaggaaatctccgtagatgttcaaagttcagaaacggtctatcatatcaaagagctattagaagaaaaagagggtattccaccatcacagcagaagttgatcttccagggcaaacaaatgtatgttaattaactgataattcagaactgagaagagtttgatatcaaattaatgtagggactcttttactaactagtaagtaatgctatctttaaatcagagatgataacgcaacaatcggcagtgccgacttgcaagatggatctcttttacatcttgttctaactttaagaggcggttgttgagagccatgtgtcattgcattgcgaaacctcaagatacgtatgtgtataagtattttgcagataaatacctggaggaattactctgcatttaataaaacgactataattattggaagctaacactatgaatgacataatttacatttacacgaccgtccaattatcaaacaaaggaaggatgtaacacatgcttgttgcttttccttgtatgcatgaatgaaccttataaatacataatgattcagatatcaaatttagtgcgaacattataattgtagaaacagatgaacttaacgacaacgatgcaaacaaaagtaagaaaaacacggataacttacctgactatactgtaacatgggtgacaatagtttatccaatgaagccatcactgccgataatattttgaaggatgcctttagccaaaagaagcagattgcagctactacgaaggcagatatattagatttggaagaactgaaagactggcaacgaaggaaaagaacagagtatgagacagttttgaaaagaaataggttagaccttcgtcaatggatgaggtatgctcaatttgaatttgatcagaaagatatacgaagagctaggtccatttatgaacgcgctcttcttgttgatcatgggtttattccactatggattcaatacatcgacagtgaaatcaaatggaaaaatatcaaccatgcaaggaacttgttagacagagcaacaaacgctcttcctcgtgttgataagctctggttcaaatatcttttattggaagaatctttgggaaatcagggtattgtacgaggcatttatacaagatggtgttcatttgaacctggtcccgatgcatgggactccttcatcgagttcgaaacaaggtgcttgaattttgaaaatgtcaggaacatttactcgaagtttgttctagtccatcctcaaatagatacctggttgaaatgggttcgttttgaacaaactcatggagatatatcatccgtacgaacagtgttctcattcgcgctagacacactcacaagtttcagcggaacaccactggtagatattgaacgagttattggtagcttcgcttcctgggaagcttctcagggagagtatgaacgatctagaacgttataccgactagcagttgaaagatggccaatttctgaagcattaaaggaacagcagattcagttcgagaagaagttcggctcttcgaaaaatatggaggacatagtaatcgctaaaaggaaagccgagtacgagcaatatctaaaatcagatccctatcattattctacttggtgggtctatattgacctggttgaggaaaaatatcaagagcaattgacatcagctttccagtcgttcattgaattggcaaagccgaagtccctggtaaaggattcgagctggaagaggtacataagaatctgcgtacgatacttggtctatctagagctcaccattaatgatttgcctacgatacgctcggtttatcaagacatcctcgacatcattccacataagaagtttacattcggtaaactgtggataatgtatgcagaattcgaaattaggcagaacaacttgctgaaagcaagaaaaattctgggtgtgagcttaggaaagtcccccaagccaaaagtgtttaaatattacatcaatttggagataaggctaaaagagtttgatagagtgagaaagctatacgagaaatacatcgatttcaatcctagttcagtgcaatcatggttggattatgcagaattagaagaaaatttaggagatgaagatagatcaagagggatctatgatatctccatgagcaataatgttggattatctgaatcggaccagctgattgtcattcagcgctatatcgcttttgaaactgatgcagcagaatatgaaaaggctagagagttgtacgagaagtatttgattttgagtagatatgacgtgaacatatggataaaccaggcgcttttcgagagcactattccaactgagacccaactaatagcctatcaacaatctcatcaagacgggaattttgacgacgatggcgaagaggagttcagttttgaaattacacctgagaataagcatcacaccagggctatttttgagaaggcaatttcatatttcaaagaacataatgaagataagaaacgccagcaagttttacaatctctcctggagtatgagaaagttcatggtaatcaagaaactttggaaaaggtcaatgctagacaaccaagtttggttagggaaaaagttactatcgataacattgagcaagagtcatataaattggattttccggacgatcgtgttgctcaacctcctattgctcgaaatcttctagctttggcaaaacaatgggagaaaaattccagctgatatgtaactttatattcatatacagataatacaattgtagatttagaacacgcatttaatcaggttggcatataggctattgagaaaaaatacgaattgtattaattattcgtttcattatcggtaaaactttgtggcaactggtttgacggtatcgaactgggtgttgatatcgtagaaggggtaagcccaggtgcattcattgtcggtacagatcctgggggcattaatcctggaggaacgttgcctggtgctgctgccaatcctggtgctgccaatcctggtgctgccaatcctggtgctgccaatcctggtgctgccaatcctggtgctgccaatcctggtgctgccaatcctggtgctgccattcctggtgctgccattcctggtgctgccattccgggaggagataaacctgggggtgccattcctggagtagcaatatttaagtttccttcagtgatacctattccagacgttgaattttctgcagccagagattcggatctggctgaaacagaagaaggtgaacctacagaagagttggagcccgctgtagcagtaatcccatcacctcctagtccatcaatagaaatttgcatcataggggttagtctatgagtatttacgatagtgctttggtcgtggatgttagattctgcatttttgaatcttttggctgcgtcggaagcgacctctattccaattctctttcttccgaatgtttgtacatagttatcttctcttagtgtaccattcaaaacagcaagctctctcaactgacctcgcttcaaatcattttgaccttcaggtgaagtgatcgccttgacgactatactttcacaggccttgattcctaatggtattttgtcctctacatctgcaataatgatgcagtgcaatggctcattcatattcattgcacctttcggtaggtctgcagcagctttacctgatctgacggatcctcgtcctctgatggaaatcttacatcccgattcttgttgaagcttcttcaaagtattaccacgaggccctagtaatagccccacaaaatttatatccggataatcctccgtagggatgtaatatttgtcttgaaaccttgtaggtcttctatagtcgtccggtgtaacgaagtttggtatcattttcagagcaatctcaactagacgatgtctttcttcttccaattttcttttataccgttgttccttagtgttggttcttctaccacgagcatcgtacacaggcggtggggaaggggaccttgcccttccagaaggaggagtcaaatcattcgatctaagctttgcagtgatttctgcaattctgaacatcacctggtatgctgtctcatgttccggcgcgagaaagccattaattactgcaggtaatcctatttgttcaaagacggcattttcacgcgcttttgctccccataatgcatcatattgattatcagtacgacctctttccattattatgatacttagatgttactgctagcttaaaggcctccttattatgttattttccgtgcggtgagttaatgttttagttattcaaattattgtgtttgtaaatgtccaaatataagttactttgcttcaatggaaatgatgaaattgtagagttgagaaccaaaaatcaaaaaacaccgtagacaggtctacttagaggaggagtttctctgtaagttcaagtagactaaacgccatccactctagaagaattagaagcgcaataacggtaaaaaaagaggttatagttttatgcttacaagtaaccgaatataaaaaaattgtaaaacctatatatgcaaaatcaaataacctagttaaccaaagcagaagcagtggcggattcgtacttccagtttggtggcaagacagaaacagttctgtagtatctagccaatctgtgaattctggattcgatcaaaatcaatctgaatttagcatccttatcttttctgtttctttccaaatgctttctgacagagacagccttcttgatcaagaagtacaaatcttctgggatttctggagccaaaccgttagacttcaagattctcaagatcttgttaccagtaatgaccttagcttgagtaacaccgtgagcatctctcaacaagacaccgatttgagatggagtcaaaccctttctggcgtacttgatgatttgttcaacgacaccgtcggatgatcccttgaaccaagctggagcgtttctgctgtatggaatagcagaagaggacatacccttaccctgtttaaaaatgataattgttagtaaatcttggacaatcaaattagcaattaattgcttgctaaactgagatagaaccaagacagaaaagaaaagaagctataactagcgattatgaaatggaggtcggtatctaattatcggaactcgattctcaataatgaacagactattctccatcagaagtatatcatcatacttcttaaatcaaactagcttcgccataatctcatcagaactcatcacgatatattgatatcggcatactatcaatacatgtttttcttttcgactctgcatcacacacatatcaaagtgtgcgtcaaatgcttttaattgacgatgctccatttcttcagacttttaacagtaaagaaatttcaatgcactaccaaacatttctggacaaaagttcttggagtcacccagtaatataccctatcaaaagatgttttgattaagagatggttaagctgaaactgtactgggaatcattttcagtctctgaaaatgattcccgacggttttcatacgacaaccaccaatggcatataccggtagagatgatccgacagatagccctcagaaaacaatcacatcaaaagtctttgatgtgatgaacctgaagtagcttctcatcattttaagtccttattcatttcaataaatgaagtgtagtttattaacgtaccttagaatgcatacgacccattttgactgattttcttaacggtgttgattggttgctgtgatgtaccacttgaaatgcaataaattagatataaacattcaattgaacaattataaagtaagataacactgatatcgttatattaaagttatggaaggtttcaaacgttctcgagatagctgttctgaaaaatactcaaaatattctgcatactttattgccctatttggaaatcattatgataaattctttccttgcgaatatatttatattgatggtgtactggtgttattttggcagtcctggttgaactctgttcacgtgacttatgtttctcctccatcaagctgctacctcaagatcgatacaaacgatacgccaatgaaaggacaggtgtcacagtattgtcaatgaacccttggctcataaggagattgaatatgggttgtgaaataccggaattatatggcatacatctttaactaattgatgctacccaatttgtagcaacttaaagaaggcatgcaaaagtatgttattacttagcttcgatctcttgtttcaattcttctatatcgtcttcatcttctagtccggatgacacctcaatgtacttattaactgcacattctgctctcaccatttccaaagcacctgcatatagcatcttccattcttgtgataccacagtggctggtttccaatacagcaatacgagcggggtctttttccttccatctcttgtggtcattggataggatagaagcacaaatctcggcatattatcaggcagtagttcagccaaatcttccaaccggttgaaatcttctaaatcttcgtcatcatcgattatgatctcgtaagatggctttggttgaatcttgatggattggatctgtatgtcatccgacctggcagtcgctgttctgaattttttgatttgattcttagtttcattactaaaatgatatatagtcgacatgttccgttgaatcaatattcacctggatcggttggcttgtttgttttcccctgtattcttcaatttcgagaatacttcaacgtttgtaaaggatgggttacgtttcgctttcacctgttgctgttcataattcacagattggcttttacttcttgttatattatctatggattttcatttccctttgatctcaatgcaaaatataaatctggaaaatagtgctgtgattcaaaatagaaataagatcaataaaggtaacgttatcattactgctgcctggcgacagacttttttatattctatacaaagaaattcggttgaactcgtgacagtatttacaagttatgtgtggttcggttgatttcaactattaatagtatcgttaagtcgtaacattttacaactagcacacccaaggttgatacctaaagaacagggtattagaaaccatcgaataatgatgggtctttgtcgtaaagagacagtacgttgagtacctcctttgcattataagcagtcattgtcataatcattttactgtacgttttcaggtttgatggaggtgataattttacatgggcagaccagcttgagttttgcacagtgttgctatgatactgctggagttcctctttagaagagttgaggtaagatgtaagagaaagttctagtttacccaggttgaataattcgattaaattccttgccattccaaccgttcttggtcgataaatgtctatgtcggcacaattcacaacatctttcaagatggagaacagttttagaaggatctctctgacaagtgctgctagctctggatctctacaattcagcttgaaatacagaaatcttattattagtccaaataatacagccaatgttctgttagttaccagacaaataacgtgggaaacgacgaacttcgaaggtgttttcattagccttagactttgcaaacccattacaaaggacttggctatttccactgctgcagtcaatgtgaagaacaaatgactccagaatagtggagactgtgttctctcaaagtggaagaacaatagtgactggttcgataattttttgactttgaagaaatagccccacttgaatttattgaagtcattgaatatggagatatttattggcacacctggtagaatttcaatttcttgttcctgctcaatggagaattcgtacgaaggttgtgtcaatttaaacaagttgagtccattattctcattgatcttgaactgtataaactgttcatcgtccaatgtgcgctccatatttctgttactgatgattagcttaaacaattgataaccttttttcaaaatgtgcttaatctctaaattgtgtttccctatatcatctaaagatatgatttcttccaaagtctgtgaatcatccaacaaatgggcatcatcataaaacacagaattgtcaaattgatcatgcactgcaccacataaaagcatatagtgcaggttgttccaacaaacaagcatccacatgttcgaatcttcatctctgattgctacccccatatcattgatcatcttacaaagttcaccatcactccatccgaaaaccgaatacatatcatcgtgatcttctaataatagcatcaacctgaacaggataagcgtttgtacttgaagctgttcgttatcctttaagaaatggatgcaatgcgataagcatttaaggtgttgatcttcgatcggatattgtaaacaccatttaaaagacgcatgattaggttcgaacttcgtaaaatacgagaataacgataggtaacctaatcttagtgccatcattaaagttgtaaggaacttcagactagtttgtaaatcgtaatagtattgcctttgttcgataatcatctggtatagttgttcaaactcattgacgtctaaaattggatatgggccatgaacattggtatagaaatgtgataagatggttctcatcttatcttgtggaggcaaaaggctgagcatatcatcgatgagtttagttgggctgtcagatctttcatttcttatcttatctacgattccttcaaccgataacggttgcaaagcattgcttgcctctaatatgcaactgaaccaaagtgacgaatttgctggatcaagtttgatgagttttgatccagttaagatttgggatacaaggaaataatggtagaagggatctttgatgacataagaataaaactcgttggtggtttcaaatctagctctaagatcatattctgcaaaagaggtatgtacaaattctgggtcattttcatgaaccttatgagtttgttcatatcgcaagttatcagtgttaccgttttcatcaccattaatattattattattgttattattattgttgttgtgatggttctgatgctgctgatggtgttgattttggtacccgtgatgagataataagggatggcgagacatgtttgaaatgttacctggagatgaaaaggatgcgctaacggaaggtagcggcgctgagcttgaagacatagctgatgacgtagcagaatctggccctgatcctggagattgcgaagatatttgagtcgcgagaggtaaactctgaccaagtgaaacactcatattcaaaccaacgtccattgggccaccagatggtactgcgctagacgtttgcaaaaaattgagatcgaattgcgatgtgttttttggtgtgaaatgagatacgagaggaacatgtgatatacctggcaaagaggactcattcggtcgttgcaattgccgttgatgcaattgtggagttatcactgaactccgtacagaattttgtttcctatgcagtttttgctgccgctgtgtctccgatatcatatcattcccaatatccaccgattgtttaattttatgttttggcggcagttcgtaaacacaatcaatcttatatttaatacaccttgcgcaagtaggtttccctctatcacacttgcgccgcgtcttcctacagttctgacatgaaaaggacatctattggtgctattactattcgttttgtaaaacccacacacagaagagatgagtcagggttttagtttataattagttttggcttccttattttaagttttatttttttattttcttatttttttttcctcacttgtcttcctctgactgtcaatcttaattcaatccggaatttctgagctgagattaagtctaaaggtgaagatgaagagagagacaaacaaagatctaaatattgaaacttggtagatacgctctatgatcgtgttattgcactggagaaagatgatgctgatgaagaaaaggaagaagataaaaagtagagacaggtagaatcccaaatgcaaatgtaaatagaaaatggagaaacctgaatttgattcaaacagagatccaaaatgaaaataaaaatactggaagtttcaataaaaaaagcagtctaatgcgtgtagtgatttccttctctttctctctcaccttcctattctaactttcagtcttcgatgcaagaacaggatgtatcgaagaagaagtatggaactgaacggtattactattcaaaatattatatcgcatatatataaaccatgcataccaagaacgatctgggctaaatcaagtcttttatgttttttcttttcgatcgaacagatgcgaagagtagagacaggatggctaatgtccactaggaagtgttcgtataatttggctgtccatctatgactgattaaccctactattttctacccatgtttctctggaggtcccttctgctgaatacacattgctgtgtgtagtctacgttctttttggttttcttttcttttcagcaccttggattttttcacagtcaaaatcaggcttggtgacattccttataagagacttttctttctttgacaatatacaaaggtggaaagatatgcacgaaaaaaagaggggcagtagtgggaccagattaatgccacgtagctccagcgggcttacatgtttcattttaatatcttgtgctcttctaaccaatatatttgctccttttcctggccttgtacatggcaaccttcaagaaaaaaacaggaaaagaggaaccttatatgaaacctacgctatttccatggttgaagagagaaggcgggaaaaccaaaatggaagttaaaaaaaaaacgacactcaatatttgcttactttggacaaaggcagagttatctggtcaagtttaagcgagtgcaagaaacgcaattttaagtgcgacaatcagatggcatacggacatcgctatgatgactacgagattcgactcaacatgttcaagaaagaaaaataagaagggtccgtttcttttcttttgttgtgcttttattttttttggttgggggagggggaagggaaagggggggggtggaacccagttttcctggtgatcacatgaaagctatatgtatacagggtcaggaacaaactttttttttctgcaaaatacagccctacgcggcaattcatgctgatggttcctggaaatgtgtaaatactaacagcgttgtgccaggaatgagtcataatcgtaagagcagaccgttcccagctaagcacgtgcaatgcaggtgagaactttgatcactttactgacccgttgcagtgcagaccctgccaagcctgttcatgtcagggtatgtacacgtaataataccagagtattctgtgctcgttcaaattcaattgtagtaaataactgggtgtcctaaaaaagaaatccaaaacagccgagggcatgtgttttttttttgatccaacagtggtatctagaacttttcagtgtgacatatgccagccccaatagaaaaaggcgtctccgattaatgtagtcatgtatccgggtaacattgaaaatggagcttatatcatcatctatcttcgtcttctgtgtactttgtccgggtaacgttgtgcggttggaagaaaaacttgagcgaacttgaaatcttcacataaacgacggaaggcgagggaacaccttcattagccgcgtcccaacgcggctagtagtaatgttttcggttggaaatgctcctggtggttcaaactacctggatttgtgaaagagaagacggatatacgtatcggtccgtcaattctcgggtataaaaagtgatctccacggattccttttgttttagagctccgtgcagcagtgaaatttttcatatttctaaatacgtgccgacattgtccgtcaattcgggtgagggagtaaatccgagaaattagtaatatttcttcgttccaaatctgagttaaaaaaaacagccattcggggttaatttctgctctccagcaagttaataacctaaagacctgggctacaggcgtccttgcgtttggaagtaatatccactcaaactcaatcgtttcttatagtgtaaaagatattctggctgtgcctactttgggcttcagttcgcacacagcattgctcagtttgatccataggaatattcggtataaacagttacgtttcctaaacgtgatttgtctaatactgccatagatttcatcgtatatcatccaccggtcaaggctaaaaccctctgacacatatcgcatttctaatcaaaaccttttttttctgctgatatccatggggttttaacgagaccttctgtgttgcgcctttttttttcaatttttctatactttccatgtcttgctgtcgaagatgtcaacaaccgtttgttattatttgcatttttcaatgtcattaccaaaaaaagtcagtgcctatattatacatatatatatatatatatatatgtgcccgatgaatattaattcttgaagagatacggggggggttacggcatgaagcattaagtttctaacgtttcgaggaattagaaggagacaagctcaggtaaaaaaagacatctcctaccatatatatcatcatgtcaactaatcttgacagtggtgcttcagagcacgccgtacaggctcgcgcatcaggaaatgataatgtgtcatatagcagctccacagcgtcgtcatcagatgtcggtgctgatagaccgttccgcggtgacgatttggaaaagggcccatctggcagtggtactgctgataatgacgacgttgctctcaagttggtcaaaactttcacgaatcctgcttcggaaacggaaattgctgttaatagaagattgtctagaatcttgacaagtacagaagacgaaccagatttgatagaagtggattactctgatgttccaccaatgggaggtggtagaccttaccctaaagctttgcccgatagagctccatatgaagttacgttcgatggtccaaatgatcctctacatcctttcaactggcctttgaagaagaaacttgtgatctgtataatgttgggtcttgactgtattgccatcaccatgggttcctctatctttgcatctgcagttaccactatttctgaaatatatgaagttgccaacgtcgtttctattcttggtattactttatatgtccttggtttcgcagcttccccagttatttacgctccattatcggaattatatggtagacaaggtgtgctattgattgcttcgtttggtttcgctttgttccagtttgctgtagctactgcagaaaatttacaaactattttgatttgtagatttttcggtggttttatcggtgctgcaccattagctgtggtgccggcttctttctccgatatgtttgacaatacacaaagaggtactgccgttactatgtttgccttgggtgtcttcgtcggtccaatcttggctccagtgttcggttcttacattgtgcaatacacctcttggagatggactgaatacgttactggtatttttgcttctgtcatttttgtcctgttatgctatttctttgaagaaactcatcacccaactattttggttaataaagccaagatgatgagaaagaagactggtaattggggtatccacgcagctcatgaagaagtcgaactctccatcaaagatgtttgtcaaaagactatcaccagaccaatctacatgttgttcactgaaccaattattttcttgattaccgtgtacaactctttcgtttacggtattctatatttactattggaagcctacccaattgtctttgtgaaaggttatcatttctatgccaacggtgaattgccatatattgctttgatcatcggtatgttctttgcagctgttgtcaatatctacatggaaaaggactatgttagaagggttatagccaatagtggtaaacccgttcccgaagcaagattattcccaatgatggttggtagtatcatcttcccaatcggtatcctttggttctgttggactggtaactatccaaataaggtccactggatcgtgccaaccattggtggttccttcattggttacggtttaatggctattttcttaccatgtttcaactatctaatcgattcgtacttgttcttggctgcttctgccattgctggtaacacttttatgagatcttctttcggtgctgcattcccattgtttgctggtttcatgttcgaaaacatgggtaccaactgggctggtttgttgttgggtttgttcgccgcttgtttgattcctgtcccattcttattctacaagtacggtagaagactaaggcaaaaatccaagtacgcttacgacctacaataagctgaatctaaacattcataattttagcgccaatgcaacctactgattgttattcttccaggacaatgcgaccgtcgaactgtgcttttttcccacgttatatttacagcttatgtttaacggggtcctcgagacgaacaaccaaagaccggttaagaaatcagaatcattaatttacaaatgcatgagatctatctcaattactgactatattctacttaatacccgatagtcaaggaaatgttttttctttgctatatcataagacacgtagattttgtaaagcaccttttctcattataatttccttcgaaactctcaatgttgaagaagtctggttttggataaatgctcttcattaactgaactgacttcgacatatcttttgaacttaattagttcattcagaactcccctaagaactacaatatttcgccggctatttctgagcttattcaactcaatcacggaagtaatactattagttattgtgttcagacgatcaagagttttcaattcatgcatactgtggatactcggttgatcaggcaaggtatacccaggaaattacggacaggtgctgaccttgtttatgaggcggcattgaccgggaaaaaaaactctggttattccaaaccaccagactagttaaggtaagaagttttgtttgaaatgttcttcaagatagtacaacgtaagtcttctacatagcttcaatataagcttaattgttctcgagtctaacccttatttttcggtatttccttgattaatacttgactttaacgaattttgtccttctcatgtttacgtgccgcatagcaatattcttgcctaaatgttagtggatacatctttgttcatgctacctagtggtaagtgaaagaaccagtacatagggaatccatcttttaattgcaaattgtgctgtcaaataatggaacattacataatcagttcatggacttgtgatgagcttaggaattttcaaagaggatacaaccacttcctatagcgaaaaagagcactccgataggcaaaattatagacagtacacatgccgacatttaccgggtgttatgatcgttcagtctcagacaccagttatcacctcaattatcaccttatggctaggtcttcaggctccagacgtgctactctttttttttttcaatctcctgcataaccattaagcgactaggttcatgtagttttgtgttcccacttttgatgtcaaaaaggaaactgaaaacgaattcccagcatgcggttcggaaacaacctatcattaattcaagaaaaaaatgaaaataatactacataatttgacaacgacaaggatagcttttgagaagaatatcccgatctatagttagttagcttacttctactagtcatatggaaaaattgttccatgtatctattttcttgctcgtactattgttctgcctaactaactttaaattggcaactttctgtgctctcgccattcttgttttttttttttctttacccgttttttaagaaattttagttgattttgagacaaaagagcataattaaaagaaacagaaacttgaaatttgaaaatgctttttatatatattgattgcatttatacagtatgtatttgcaaacgagagaaaaactcatacagagaagtagtttatctttttacctttgagatcaagaacaaaagtcgataaagacaggaggcgatagttttgagaaagagatcattcagaaagcgtgctcgtaatacttcgggaatatagaaaggctattgattttagtatatcatcctagtaccagtttttgggactcctttttaactcacactggctgactattacaccaaagattgatacaagttagtgtcgcagcttttatttgtgtttatattatttttactaccttaaagttctgggattttttctctggataagagcttcgtataatcttttaaaggtaattaagtggggctcaaacttttaacaagggtatagttttgtttcgttggatattaaggccatctttaaggatgtctacggttaatatgagaccatctttggcctccatttcaggtgtcggtccttctggtccaactactgccacagctaccagttcaaggagtttcaaaccgtgtgcaaattgtacttgcagttacgggcagttgtctagacaaggtagaagatcatcagctttattgaaacaaatcaacttttccagaaggcattctcattttgggaatccacctttaagtcctaccagtgaatccatatattcaactgattctatttgtcagctcaaaagtactgaaaccgcaaagagattgcttgccttaaggaagcaaatggatacacatgatttgtgctgttacattattccatcagaggacgaacatcagtctgaatacgtttctcaagctgacgaaagacgtgcattcatttctgggtttaccggaagtgccggagttgcctgtgtaacaagagacttattgaatttcaacacagataagcctgagggcgaagctattttgagcactgatgggcgctattttaaccaagccagtcaagaactggattgtaactggactttagtaaggcagggagaagatcctataacttggcaacaatgggctgttaacgaggcacatgaaatgtcgcttgctcttggtggaaaaccaacaaagattggtatcgatccaagattaatcagttttgatcaagtgagaatgtttgagaaagtgatcaaggataaaactgaaggaactaatgcaaagattgaatttgttgctgttgcagataatttggtggataaaatctggtgcgagtttgaaaccatgcccgtcagagacttaaatgaattactactattggatcgcaaatatactggagaatgttacaagtctaagcgtgagcgtgttatgaacaagatttcaaaggaccacaatggagcctctcatttggtagtttttgccttggacgaaatatgttggttattaaatctacgtggttcagacattgaatacaatccagttttctttgcttatcttgttttgtccaacgatgaaacgatactcttcactgataatccatttgatgataaaattgaaaattatttgagtgaaaataacatcaaagttgaatcatatcaaaatatctggtcatttttgtctgacaaggcttctgcccttgcggagaaaaaagaaacaattctgattccatccaactcatcatgggaaattgttcgtaagttatatggttctactatgaagcgtgtatcgtctccaatcgaagttatgaaatctgttaaaaatgagaccgaaatccaaaatgctcattctgctcaagtaaaagatgccgtcgcgttgattcagtatttctcttggttagaagatcaacttgttaagcatgagaaattaattgatgaacacaaggcttctcaaaagttaacggaaatcagaaagacagcgaaacactacatgggtaattcgttctgtaccatttcatccactggatcgaatgctgcagtgattcattacgaaccacccgaagagaactcgtccatgatcgatccaaacaaaatatatctatgtgattcaggagcacaatttttagaaggtacgacagacatcacacgtacgttacatttcacggagccgacgcaggaagagattgataactatacactagtattgaaaggtaatttggcacttgaacggttggtggttcctgagggcaccagtggatataacatcgatgttattgccagacagtttttgtggcaagctggactggattacaagcatggtacaggtcacggtgttggttcattcttgaatgttcacgagggaccaatcggaattggatacaaaccacatcttgtaaatttccccttggaaaagggaaatataatcaccaatgaaccaggttattataaagatggtgaatacggtatccgaatagaaaacgatctactcgtcaaggaagctgaaggactacaatttggtaagcgtaaatttttgaagttcgagaacctaactatggtaccttactgtaagaagttaatcaacacaagtcttttgacgccagaggagaaatcacagattaacgactatcatacaaggatatggtcttcaatcgttccattcttgcaaccatccagtattgcattcaaatggctcaagagagaaactaaatcactatgatccgtgcctttcttttctctattagatcactgattttgtctacctattcggaaatggtgacagaacttgttccaatttcttcacatgaacatgcgttttcttattaatttggtccatattagtatttcctttctattcaacttcttaattcaccttcgtttatcagaatcaccattttttttcactgtctattcagagtcaactaaacatatgcaacgtccttgttgtctgtctatataagtacttttaaatattacttccttcgttaacatgtactggttgcactagtattaatgccattcattacccatcgccagatttccccctgttactcatatttgtcacgtgtggtcacatgttttcatccgggtaaccatatcctgacaagtaagaatccttttcgttttttgctgacgtgagatgacagttacccgtcccacatcccttacttttccccgggatccgaacacggatcaagtaggaaacgcgcagcgggactgattcgttgtaaactagtcattcacttttttaacttgttatgatgtatgcacaggagaacagaggatgagaaaaaaaattgaaaattagaggatatataacgaaacacttataataaagcatactttctcccgtttctttggttagattccaaatttgctagtatccaaatcatcaatcaactgaaggcaggccatactctcgcacaggttgtacagagattacattctgattctattattatttattagcatacaacgttgtggtttttctacatcagtacttgaaatattgatatccatcgggtttgctccaaaagtccaaagaaggtaaaacaaagtgaaagtgactttctcacgcagaaggagctctatttatctattgatttcaaacgatgcaaagacacatactatctagaagcaaccagtgcctgctgcgtggcaatgtgctggcagtgagacatctttctcaaaggccactggcaaggactaagaggtttttgcaaacctctcagaatggggataaagtgaatgctccagtttggccattcaattttgaaattccagtgaagaacggtaagagtagtgcacctggtacacaggaagaagcatctggatctgggaccgcaggtgctaaaaagacatggctcacttactcgcttcctaaaaatgttgccaagaagggggaacctttacagacccaaccacccaaagtcgatgaaaatattcaaccaaaaaaacgtgcaaagagaaagctaaggccacgtaaagctctaatatcgttgacgcccaatgctctttctcatttgaaggggttgctcgatcaacctgaacctaaactaataagaataggagttaaaaatagaggatgttccggtttgacttacgatttgcaatatattactagtccaggaaagttcgatgaagtggtagagcaagacggtgtgaaggttataattgattcaaaggctcttttcagtatagttggtagtgaaatggactgggtagatgataagttgtcctctagatttgttttcaagaatccaaactctaagggtacatgcggatgcggtgaaagtttcatggtataattaatgcaagatctttccatcatcatcggcatcattatcatccacaactttgcattgggatgaagcataaatattcatcacctgtaaggagcattgactgttgtcgctttcatccggattgcctctggagaaaaataaagaaactaacagttgacgcaactaacacaacactcaccccacgtattattcttctgataggtttgctacctcttactacaaggtgtttagtttggaaaactcattctaacgacatttatttatacaatagcatcggatcctgatcttttttactagcaggtattctttccatttggggtacgtacgggggcataaagcgtccgggacgctgatgatatcccccggaggagaattgcttgaatttattcttttattcatttgttcaatgcgatacaccctaagaaatcctccctcattcaatctctttcttccacaccaataatacccttaaacacaattacaatcatcattataattctatatgtatatttattggtcacaaaaaatgctacctgatgtagctcgtttataacttttttaacatcatatttattctatcaaaccatattctagctacgttactttaattaaacggacgttgcggttgtgattacactaatgggagagctctattaatttcgctgtccaaggatatatttgctgtcccaatattaaaaaaaatactcgaaggtactttaacaaaattaatggacgtgcacgtcccgcgacagaataaaattcaaaataaaaatatatacactgagcacagaaaccaagatgtgcagtgacacaaaggtttctcttacctattttctgacatggctctctgattctgtatttgtaccccattccttgtcacgctgaaatattttaaatatataaacctctttgtataggataaaattacttctctttttaccgtcacaaaaggcacttctcttattctactttacagtattattaccacctagaaactctctaaggaactttttaaataagcactcgtattccaaccggttttttaaacaagtccaggaaaacaaacttaccaaagtctttattcaattacacttaaaagaatatatctgtcatgcaacaaaaaaagctaattccaattttagtcgctcttccaatagcactagcaggtgctgatagagagtctgcgccagttgtttatgaaaatccagagaaagcctgctaccttgcagaatttcctcaggttggctccgataaggttggtggatacatcacactttcactagtcttgatggaattgccaaggtaaacgtcagaatatcgactttggagccaaagcttcaatatcacatccacgaaaaaccagttgatccatccgatccaacttgtgagtctacaaaagaacacttgaacccttacaatgggcaggtgccatgcggtaatgatatctccaaatgtgaagttggtgacttaagtggtaagtacggtaacatcgactacagttattacgagacggaatatttggatccatacttatcattgatcgagggtgatcccgcttttgttggaggtagatcaattaccttacattattctaatggtacaagatatgcatgcgctgacattgttccatgtgagaaattgaagccatctccaaaaccaccaaaggaagacaaactaaaggaggacgaaccaaaggaagacgaaccaaaggaagacaaaccaaaggaagacgaaccaaaggaagacgaaccaaaggaagacgaaccaaaggaagacaaaccaaaggaaaaagatccaaaggacgacacatcaaaggacgaaaagtctgaggaagagaagccaaaagaagataaaaaaaccaagaaagagaagaaaaaggctaagaaggaagaagagaaaaagcaaaaggaagataagaagaacaaaaaacatagtgacaagaagaacaaaaaacatgatgatgatgatgaatactccgaagctgaaccttcagtgactgaagaaaaacgtgttgagacgagtttcaccaagaaaccacatcacactacctctgctgcattgaaggaaggttacaaagaggtaaagaacgaaacggacactgaatggaaaacagatgacggtcactacaatggcactgagactgatcattctactgccctaaatgatgcttataattggaagagaacttcgtccataggctccattattgctttcatgatgtccttgttaatttgattcaaaaacgaaagatcatcacgcacatgagctggaatatctagttatacatatgtagatcttacaaggaaaataataatatgttgctatccaaaacttgacacaatgccaatgatattgtcttaattaacgtgaattacaaaactgacgcctgacatcgaaacagaagtgcgttccaaaaacctagcgttaaatttcaaaatctatcacgtgatggtgatccacttgttccagtttttttcttcggttttctttgtggacatgcactttcgagagtcttccagaaaaatccggtaatgttctagctatcacggttccggactctagcttagagcagagtgaattttaagtagctttacaatccccacacagcttctacattgccgtaagcaacatgctgggatagctggttgtttgatctagtattcaactaacaataaggacgtacttacaattttctattttacgtagccatgaacgtcagtcccaacggtaatttaaaagcttaaccttgagtgagtgaattattcgagaatgtactggtttatactggaaaagtaatgtagttgttagagctttgtttgtctgtgaattgggcaatactaaagctgggactggtaccgggagataggggttgaggtatattttgctttgctattagttttcttaataaggtgattttagggtatcttttgatagatgcttatagaaagaataggtgaaaaaaaaagtttatagaatataagcgtagtgaagaggtatataaagggagaccatccgaagaatcatttgttgagtgcttcctgctttggaattcaattacatcaattgtatcaatagtggtctatctgatagaaataaacaacaattgtcaggatcatcaaacgcatcaacagtttattgtctagaaagaagatattactacaatgaacgacgaaacacaatttacaaataaggccaacgaaattatccgtttggcccagaaattggctcaggatcacagacatgctcagttacaaccaattcacttacttgctgcatttgttgagccaaacgaggatggttctgttggattcttacaaaacttggtggaattagcgaaatatgattatgaacctttgaaaagggccatcaacagaaacctagtcaggactccatctcagacgcccgcaccattagaaattcagccaagttatgctttcgggcaggtcttgaaagatacttcagaaattaggaaacagcaaaaagattcattcgtcggtcaagatcatatattgactgctttgttcaaagatgcaacaactcaaagcatttttaaggagtgttccattgacatagaatctgtgaagcagcagatgctcgaattgagaggcaatcaacgaattgattcaagagacgctgatacaaatgaaaaatgggaatatttgaagaagtatgcgatcgatatgactgaacaggctagagcaggtaagttggatcctgttatcggtagagaagaagaaattagaactgccatcactgttcttgctagaagaatcaagtcaaatccatgtttgatcggtgagccaggtattggtaagactgccattgtagaaggtgttgctcaaagaattatcgacgatgatgttccacaaattctacagggttgcaaattattttctttggatcttgctgcattgacggctggtgccaaatataaaggtgatttcgaggaaagattaaaaggtgtcttgaaagaaatcgaggaatcaaagactttaattatattattcatcgatgagattcatatgttgatgggccaaggtgtagatgattctgccaatgctgctaatattttgaaaccagccttatctcgtggtggcttgaaggtaattggtgccactaccactaacgaatatagatctttggtcgagaaggatggtgctttcgaaagaagattccagaagattgatgtccctgaaccaacgacaaggcaaacggtagctattttgagaggtttacagccaaagtatgaaatacatcatggtgttagaattctagatagtgccctagtgtctgcagctcaactagctaagaggtacttgccatacagaagattacctgattctgctattgacttggttgatatttcatgtgccggtgtcgctgttgctcgtgattctaagcccgaagaattagacaataaagagcgcgaattgcatttactacaggttgaaatcaaggcattagaaagagatgaagaaacggatccaacgacaaaagaaaggctacaacaagccagacaaaaggaagcttcattaattgaggaattggaaccaatgagacagcgttaccaacaggaagtggattctcatgaacaactaagacaagccaaaaagaagctcgatgaattggaaaacaaatgcatggatgccgaacgtcgttacgataatgctaccgcagctgatttgaaatactttgctattccggatatcaagaaacgtattgaggaattggaacaaaaagttgctgaagaagaatccagggaaggttctgaaacaatggtgaagaacgtggttaacagcgaggttattgccgagactgccgctagaatgaccggtattccagtgaataaactaactgaatctgaaaacacaaagttgatccatatggaacgtgagttatcgcaacaagttgtgggtcaaatggaggctgtgaaagccgtttctaacgctgtcagactttctagatctggtttgtctaaccctaatcaaccggcatctttcttattcctaggtttatctggttccggtaagactgaattagctaagaaagtcgcatccttcttgtttaatgatgaaaaagctatggtcagaatcgattgttcagaattgatggagaaacattcagtttcgaaattattaggtactactgccggttacattggttaccaagaaggtggtttcttaactaatcaattacagagaagaccatacagtgtgttgttatttgatgaagtcgaaaaggcccaccctgatgtcttgaccgttcttttgcaaatgttagatgacggcagaatcactagtggtcaaggtaagacaattgactgttcgaactgtattgtaattatgacttctaatttgggtgcccaatttatcaatgctcagactggatcaaaggttactgagggttccaaagagttggtgatgagtgccgttaaagcacatttcagaccagaattcttgaatagaatctcaagtatcgtggtattcaacaagctttctcacaaggccattcacaaaattgttgatatcagaatcaaagacttggagaagcaatttgcggataatgataagaattacaagatcaacgtttcaccaccagctcgggatttcttgaccaagaatggttactcggaggatatgggtgctaggccattgaacagattaattcaaaccgagattttgaacccaatggcaatccatatcttgaagggtgagatcaaagacaaagaaattgtcaatgtagaagtgggtgccgatggatctcatttagaagttttaccaaatcacccagcttcatcagaaattggtgatgaagacatggatttggacttggacgacgatgacgacttagacctagactgatctaaaatgaattacaaaaagaaaacatacaaacaaactcactcagtaataaaatttcagttcaacagtaccatcatatatagtgtaaagtacatatttttttcactttctttagtataatattttgacttttacatgttttcatgttcataagaggtgcaaaccaatggtgctgctgttattcatacaagcgtactaactaagcattctggctgagtttgtattacatgttacttagatgggcagggttctttcagcctttttcactgatttcccaagtcagtaagtccaattttgcacatgattcaaaagaatttgattggtctttcttcaaatcatgcttctttcctcacgaatgttaatcttcggcttttttcctcttcttccctcgttccgtggagttattggctgagtaacatcccatatacctttcgttctgggcatcgctaaacatgcttggtaaagagatagacgtagatcattttccctgaaaggcttccattattacatgtcaaaaattagcaggcaatcagatggactaaagcgtacgctcgcatttggatacgagcctctctataattcgaagacacacgtaccaatgtgtgggataagacgcaaacgcgtcggaagggaaggaacggaaaaacgcttatcggcctctaagaaagaatgcagaagcgaagaaaatccagcactgtaaattcgtttcatttcgtagattcatctcaggtgcctattttttagtttgtatgcaaaaggacatgtgttctccttggttttttttatctacagaatgaaggaggccggatcttggcagtaactgttgttcggattacaagattgaaatgtttctggcttattaagagtacaggaacttgagggtgatttaccggtactttgtttggttcgatttactattttattgattgattgaattatgtcttacaattgccatggttaccacaattcctattgtgctaacagatactataattattatttatttacctgtgccacgctaactagttcaagtgcggatttgttttgcatataaggagagcaacccgttttttcccaactctgccgttgcatttttccaacaccgttttgagtatgaacaatgtgccgtatttgcatgcaagttaaaaagaaaaaacagtcaataatgccactgtgggtaaactcataattgtcatgttgccagggtttctttccataccaaacgcgtactggaggtaatcgacttttttttattctaaatcaggaaattcaaataccgtgatgcaatgccactacatcaatatgtacattcccgaaatttccgttggtggattccgaaccacctttagctcctcgtgcatgaggcacttacagtcgcgtcttggctggacccgtagtagtatatagctatctattctatatatcgtatacccgattttgcattatcttacagccgagagcctgtgcttacatttccggttaaacagtttgagatattagggtgatttctttttgtaatcggctgccaaactaaggtttactcctgatttgaaaatgtggactgtttttggcattgttttttctctaaattctcttttctttgcgctttttttgacattttctctgattgtgctgtacagataagacgttctgaaccatcactacaaaaaattatgggaaacaatttctattctgtttacttgaagagcaggcaatatagagattgccattctaactgacatcctactatgttttttgtgaaagcgaaagcctatccatttgcgtatattattgttgcactactagattcgtgaaaggattatcgtgccgtgacatattaatgcatgataaaagcaggaaaaatagggtctgatctaaagcatagctgcagtcgccttagaagctaccgtgcaaactaataatagaaaaaatcaaaggatacttactgttcggggtgtgcatgcgatattgtgataccggatttaaccgtcagattcaccacggcatctttttctgaggactccgaacatgctctcatttgcaagatgtaaatgaaagcacaatttcaccgagaaatactgtgcatctgcttagcagtgaggcacaccggtaagggtatctcgatttctcaccaagaagatgcagtcaaaaaattagtgaagccacgattagattatgatatctttcctctttatttctcttcattttcattactcatttgcataattttgagcctgtttttaccaagtagttatcgaattctttcactgatttttgggcccaaagtctgtaagtatgataaaggttacatcatgctcatgtaggaatacattaaaagtggtcttatttcgcattagaaataaacccccaacgccaccatgtttggaatgtttggaggaacatgatccccgctctctggaagatgttcacctttgaggggactaaagccagctacgagatatctaagacaaactgcagaaagtatcgtacagatttcagctgtaggcagaaaaaatgctgttcgaatccaaatgaaattcattgaatctttttttttcaatcataattttttgatctgcagtacgaatatttctgcgtcaaggcaccttttcactgtacgtaaaaacagaaactcctacaatttttctttgtgttgttagtactgatttagtcagcactaaaaagactagatataaagtttttgcacagtccatggaaattatttacacactagccaatgaggggatctaaatttttgggaatactatggctttagaacaactgaaatattcaaaagagaaggcttgcagattatacggagtgtttggcttatatttttgttttcatatcattcttctagggaaagaagagaaacgacgattctcttctgtagtggtaacggtaaagggtatccaagctgctaccagcacaacgcaaatacaagtattagactagaaaggatttcggacccttagaattctaatgatcgaagttagccagaagggttgaaaaaagaaaagtgaacaaaaggcgataaacggagagtgcagaaaaaattgcagtgttaacagcggcaatgcacgtacaaaatataattattactagtaaatgggaataaccaataaaaaggcactagcaacggtatttcagatgccatatagcagtaaaacaaaatactaaacgtgggagatcccgataatcgatagagttaacaacctgttcgttaagtgactggggctattttaaaaacatacgcggcattagtattagattattaagtctcgattgaatcatattcttatcaataatccttactaaaacaaaatctagaagaatgtgaattataccattctcccgtagcttcaaaaatgtcaaaatgctgcagttcggtttttggcataatgtttgatacttttctctaaaatgtgccttttacttactgattttctagaattattattttaccttaacattatttcagaaaagaagtaaatttatgatgttatattgaatgacggggttcattttctgtcctcattagaaaaggggaacagtcttgtataaacgtagtaatgggctgttaacgattggagcctttctgtttattcattcttttattgcagtagcttttcagtaatagtgaataatcctgggatatagcaagtgtgcgtaatttcatctcttgtctcttcggtgaaacttactgacaacagggtagcttcattcatttcggcattttttagttccttattttgtattagccttatcttttatttctgtgcaccggatatgatatggtaaatagggaactaatgacaacagttgtgtattccaaagcagctgtggttctttgcagccatcaataccgctttttatttggaagtttgaactgtggtaaaatcagcatatggttcaagagctttacaatatgtaagagttctcgataagcataaaggtatagaagaggagaaactaatcaccttcaatgcaacttaagattaattgtgacgtaactgaaaaattcttctcacagatagtgactcgtcctaaaaaccgacaaaagaaaacgtattatcagcagcaaattctgggtccaaaaaaatatcgcgtcaaagatataacggtgttagacgctaagctctctgcagttttattctgccttcttttctttaatttttcataaccaatttatcaaggcacgcttttgtctatgtcctgctagaatccataataaaacgcccttcacctaatatatggctactttctaaccaaggagatctttcatttccacagcactttctgttatgtacgcattccaaaaaccgaagaaaaatatagatgatttgtacatttccctttttgtctcctctcccttttttttctttccgttctacagtatcttctgtgtcatattcattcgctctgaatagtgtgaacgggccaatttactaaattgtcacgaactgaaaaataaaaagaactcacacgacatacatgcacaacgtcttgattaattaagaatttctggctgttcaatatatgtaatttatttgtttatttctagtttcgattggtataatcaaggatactactactagattccctaagtccttttcaattgatataaaaggaaacaattttagctgatttctgttgccatttcctcaaaagaatacattgaatctcgattagtatatctaccctaacaggactccttctgttccttttttttttttttgacattgtttttctctcttttaattagtttcggcggttcttttcgatttgcggagattttactttaccattttcctggaacttctggtaactagtgcggatacttttacgaataacgcttatccttgtactatcattattgtttattagttcaacacagtagcaaaacatttcagaatagatttgatttgaaatcagtgtcgaagtcagggcttaagcaaaataacgttaagacagtattttcaggtgtttccataatataaaacagactgaggtaaaaaagaatagtggtttacaaaccttgtttggtagaatcaactttttctgagctttcgcttgttttggctgtcacatatatcgaatttcgcatttttaaaattttttttggcatcgttgcccatattctgacgcacatatatcgctctgcttttgcttgcgctattcaaatatccatacactgcaattttatcttgcggtattctggttcaataaatcattatttttaacaactggctcttccatttcctgcaattctgtcaaggagcaacttaaagaaaaaaaggaattacagtcctgaaatataaacctatcgagtttcatacttgttagatctgagattagctcctcgcaatcaagaattctgtttttactttgatttcttctttcttttggagtacaagaacgcataatttgggttatttcatatagctagtcgaatttgtcatctgaagcattggccgatttcatcatctgatattctttctacgacgactctattagtttcgctgaaatccttttcggcttctgagaacagtctctacagttctattttcagatttttacccgatttggcttcgtttggtacttttttttttagcagccaatgcaagtttgaactggaaaaagaccgttcaaagagtcacaagataatacagggacaaaatattcaacaaaggagcattctgaacttttgaaagatagttttatttcaaaacttgcctccacacaattgcaaaacattattatatccctgttttttattatatccagttttcatatttttgttttgaactcgtacacatatcaaacagtgaaaactgcactcaaaatataataaccgatcaattataaattgatttaagctgcaatacctttctccctcattgtgttctccttcctatctttacacaatatctttattatcttgtgttttattagctgttctgattctccttccttctccttcaatcaaatattaatattgaggagaggaaacgaacccataatccaatagatcaccgacataaggcaaaagtacactcgcacgttacaagactgttgaccataccgtacgaataaaggagcacattgttttattccattacaaattccgagattatatcgcctagaaataaaagtagggggctatctggacatatttatactatttgtccacttgttttttccctctcttggccaggtcactttgccgcagtacttgaaaattaagacaaatttttttttgagaaataaaaccggagctgaagtttcagaggaaaagcgcatattcccccccaaagtgagaaaaaaattgcacgattttcacgacgcaagaagatccacggcaaaaggttttctatttctcgggatacaatatctttctatcacctccattctccgaacaaacagggcaaatcatagatcgttttaaatagggtttgtgaccaatattttctccacagcgtgccatatcaataacgttgctcaggtcaaattatattaagaaggctaaatcataactagctgcttcgaacccacagattcatcgaaccgttttgatcaaaacagtttctttgttctgaagtttgtcatttgaggaatcaaaatttgtcacatcactattgattcatcctttttacagatctgacttttttttcgttttttgcacagaggaggaaagccgaaaaccttaatagtgcctaacgtctaaaaaaagaaaacaacaaagagtaatgtcatccaatatgtcgaaaaacatcaacgagagttttaaagaccgtattgtgattaatgattcacccaatgagtcaggtgaaatattaaggcaaaggtcgaatgaaactgaaaaccaaaccaaaaataaagaggaaatttcttcagataaacctgtcatcaatttagaaaaggaattgactgctcttaaaatcgaccgtcaatcattgttagatgataatttaacaaacttgctgccagaacagctttctgaaatagcaagtgaatcagaaacagattcagatgaggatactactaatttgttggatgaaccgtctccaagatcctctgatgacccttccttttcaagaccatcgtcttgtattttcgttgcgtctttagcggccactcttagtgattccgaactcaacgcatccgtgacaaaagagtttgcgaaatatggtaaaattgtgtctgtgaaagtattgcgtgatccagcaaacaggccttacgcatttgttcaatatgcatcagacgatgaagcattgaatgcgttatctcaagctcaaggtacaacgttaaacaatagaaatattcgttgtgaaagagcaaaggtcaacagaactgtattcatctcgtcaagttttgctaatccactagagggaaaattaactgttgaaaaagtggtagatttgatgagtaaatttggggaattggaacaagttgtccctagcagagaccaaatgtataagaaaaattattatccaagtgaggtagcaaactcttggtttatccaatacgcttatcgggacgatgcgattagagcatatttgcaaatgaaactcaattacgaatacatggtggaatgggcacaaaatgtcgatgttcctccaaggttcaatttgctactttcaaaggctaaaatttgcgaaaaggaacgattagaaagagaacgattcggtaagcaaccaattttcatcgataacaagtccatattcataggacaattgaattttaaagttactaaaccattacttttggaaaggttttcaaaatatggagaaatcgacaattgcaacttgatccacaagcaggaacaattgaaatgctttgcctttatcaagtacaagactccggcatcagctgcaaaagcgttggaaagagagaatcattcaatattcgtggagaaaatactgcatgtgcagatcagagaggtatctaattcaaggcgtagttcaattgattccaataagtcattccaggggcctcagttgaacttggcacctccgcctttgaatataggaaggagagcaagtacagggtctttttcaaaatacatgtatccattaccaaatcatttacaaccaaatctgccatctcattatgtgtatgctacgatacaagaaccaaggagaaatactataaactcaggctcatcatcctaccacaaccataatcatgttttcgttggcaatactggttcacaaggtttttataatgaaaatggtaaccagtatgtttatggcacagaaagcaaaaattatcccaacaaaacagacaatggagttgaaaaagaaaatgcttatctagaaggtcctcagcaaatgcatagtacccacttcaataggtcaaaagacgatatcgaaaatagcacaattgaagaagaagatgatgaatatgaagtcgatgaagacaatgatgcagaggacacacatttcttagaacacgagtccaactcatcattcacaactttcagcgcaggcactggaacgttcaaacataacaatgcgcataacactggttcttatcaaaagaatcatagttacaagaagcgaagaaatgtagatgcaccaaggcatggtaggatggatccaaatttctactacggcccgccagtgtactacccaatggagtactgtccaccttctggtagccccgttggccctccgccctctcacttgattcagccgggcgctcacttgacgggacagtgtccaccttctcaacattccccattcttttattacttccctatgccacctcctacaccgacatttactaatccattcccacacgaacaccctggcggtatgaactatttggataattctgtctctggacatgataaagcagacctcgactattgaatatgtcattttctttctacttttttttagcgtaatcattgcactatcttaggccctcctagtgattaactctttttcaccttctttttagtcaaccacagggcatatactcggcaccgtcttataatatgttccccagtggcgtttcatttgtacatgtccttctcttttagataaataaacttaagatatcatcttaaactttacatgcatggcatatatatatagatatgttttctgttcgagcttctccggaattacaaactgttatggttacaacatgcaaaacaaaaaatataaaacacagtgaattgattagttatgacataaagttatgcaactccaaaaatggcttattatatagtacttaattattatgcattgacaaaatcctgtgcgtagaatcgattagaagaataacaatgtaaggggatagggcatttaccagtgttttacttcaacgatgtacttacctaaggcctgaagcaatctttttatctcatttttaggaataccttccttaatcataatgtactccaaagaaaccttcccattaaagtatttcaccacttgtctaaatagcgtttgaagatcagtaggtaatgcctcagcacatttgtacaaccatctcttttctaatgcagtattacgttctggttcaagaattatagtgaaatcattatcgttgatcatctccaaatcatcaaactcactggagttataattttcacctccagtaacaaaattaccggacttttcgtgtttgttcgatcttaagttatccttttctagatcctcatcgacagctattttaatgcgcttgtccacacgtacatacacaaacgtcaataattgagtgaggtatccgtacctcatgagccatgccagggcattcaaatacatagatttatgttcattggatggtatgatatgcccgaaaggtctgggtttctgggttgacataagttgaaggaacgatggcaaagaaggtaaggagggaaatttttcattgaataccttcttgttttggtatatcaacgacggttcatcgttgttattcacaggaacttcttgttgtcttattaaggtgtcgtattcgccatgtttgaagtcatcagttgaaaatcctgagattggcgccaatggagaaactatatatgtgtttctcgatgatattggcagtatcaaacgggcgtgacgccagtatattaaatgtagacataacgactttaaagtagtttcacagaattgatcatcatatgaggaatcattagaatcgattagctctttaattaataatttatattgaccaagccttatagtgggcttcaactgtcttacaaggttgatcaaaagtaaatcagtaacgccgttatcaaaggaagcgttttcaagcccttttataatattttcaggttcatcgagcaaaagcaatccataatctagaagcctgtcgtggttggcatacaaattatctgaatcttcgtttgtcaagctagtgcttctaccaataaaactttcgtttagtattgaggataagaaagatccacgaagaacagcatcttcttttaaatttggaagaatggaaaattcatttttgattggaatctgcaaggaaacaattttatcaccatcaatttcaagattagcaatttcattgttatggatgcaattgaaacattttgttaacgctctagctagtgacgattcgtaaagaattctttcatacatatattttcctttagaccagggagattttaaagactcataatatcgagagtgtttagaaacttcgtccttacacttcataattttcacgcattccctagtgacataaccggtttttccttgtatgtaccttaaaatcaatgataatctagtcaccacgtaatgatacatatcatcgactctttcattatattctatgatctttgggttcatgatgaagcagacctggaacatgtttatactctgctgcaaactttcgaattcatcattttccgcatcaggcacacagtacatttcattaagcatttctgatttggatggttcataatcactattctcatcatctgcaggttcttcaacatcattaatgtgtccttgactctctgttttagatctgtttcgaccaatactatttcgaccaacactatttctactaatactgtttcgtgcagtgctacttctagccgaacgtttggaagcttgctttctcttctttgatttcttccatcttcctttgtgatccgcgtgaattggcaaccctaagaaacataagtcatccacagtgaattcaaatctggtgttacacatctcctttcttggagaacagagttcagctacaaattctgtattgaaatttagtacttttgagatatcctgaaatgtatcctgctgaaatattgaaccatctagcaaatcgtctaccaagattttcaactcttcatctactgcatccaattcatcttctggtctcggatcagtcgtactagacatattagtcgatgttctaatcgagtgcaacgattccctcaacgagttttcgccattgattgcaacattgttattattctgatttagcacttgaaagagtttattcgcactaatctgagattgacgagatcgtagaccattattgataaatgtattgtttgtactgctgtttacagtatcctcatgatttgattgtggaagggagtctaacgatgattctgatgcatcagatgaacaatctgcatagtcagtcgacaactcgctatcactcaaacctgaagagtagtcatctgaagacgaattgttttcagagtccgtatactcgtatcttttcttgatatctgggtgatgcgtcttcttcgaattggtcgcagtagcatagttgcttggtggataatgataaattaattgtggacccgaatgagttgaaacagttaatgcgatttgtactaagcaggaattcggtaaattcgtggacattgagctattcctatctcttggagcttcatagactgctgaactcttagattgagggaaagattctttcgaattagcagttataccccagtacttttgtatattaggtgttttatcagttaatcaagtaaaatgactatcgtattttcatatttttcatgtgtagatatttctataataataagggaaactatatatgactggagagacagcacaagtagacactacgaaatctcctttggtttgttaatatcggggtgtcgtatatgcttaagtttttggaacagtaaaactcaaacgttgctgaatgtatttgagggcttttaatttgtcgtgtggtgtatgttcctgcagttttaactttcaaaattagataagaacaaacagagattaaaatattgtctgctaagaaagtaggatcgcgtaatcgatactagaacatctcaaaaggtcctgatgttactactattattcttgaaagtttcattaaacgtaaaatatagtgctattgaaatcaattatgtatgaagggattcagagcgagagaagaaaaccggattcattatcgaaccatattgaagtaaaattattttgaggtgtcgacaacgtatctaccaacgatttcacccttgaccatcttgtcataaacatctgccaattcagataatccgactatcttaattggagcatgcactaaacctcttgcgaagaaatctagagcttctctggtgtcagctctgttaccgacgtaagaaccaacaatggagaccgatttgacaacttgtgtaaagacatcagacttacatttggcgtcccttggtagaccgaccaatacaacggtaccgtttgatctaacgtaattggtggattgttctatagcaaattcggagacagagacgttaatgacaccgtgggcaccaccgttagtagcgtcaacaatttctttaatcaaatccttagagacggcataatcgacgaagtattcaccacctagctccttgaacaacttagccttttcagcaccggtatcaatacccaagactctgtaacccatagccttggcgtattggatagccaaagaacctagaccaccacaggcaccggaaatggcaacccagtcaccggccttcaagtcagcagattttagagccttgtaaacggtaacaccggcacatagaattggagcaacttcagccaaatcggtaccctttggaattctagcagcttgaacggcatcagcggtagcatattgttggaaagaaccatcgtgggtgtaaccagacaagtcagcatcgggacagttggattcattggacaattcacagtattcacaggacatacaagaaccgttcaaccatttgataccagcaaagtcaccaatgttccagcccttgacattttcacccatagcaacaacgacaccagcaccttcgtgaccaccaactaatggcaatttggttggcaaaggccagtcacccttccatgcgtgcaaatcggtgtgacagacaccggagtacttgacgttgatcaaaagttcgttggcctttggctttggaactggaatgtccttgtattgcaattcaccaccgttttcgtaaaagataacacccttttgagtttcaggaatggacattttttaattaatattgatattctttttagcttgattgcttgttattcagtatgatagctgatggtgatttatgtaactaaatgtgattggaagaacgacaattattacgatctcaacaagagaattggaaaatatactaaaatccatccccttatataagttctaatttcatttcttttcaaaaacctaaccccatcactttcatagttctaccctataactttgtgggggcatcctttaacggtttctccaggcccgtggtgagctttagacagtataagaatccagtgctatgtctagctggcaaacaaaatttaggggaacctcgatgcccatatctaaactaagctgaaaaaaaagaaagaagggaaatcgagatagattgtgattctttgacagaattcagaattcaacatcacctgttgttgcatcgatacggtctgatcaatcggaactgctcggttccatcttgaccgattaaattctatatggggattagaagccaaggaacagccagccattcgaaacttaggacaaataatctagccgacatgcgacagaactggatatagaagaacataattggcagagtttacgcagactaccagaacagagcaggacagaatatggtacgatattgatcgtgccatatacacccgtacagaccatacagaccgtatagtgactattgaaggtctattattggtagccttcaagtgaaagaaggacccactggctgcgacatccactaacgtggaaatagcctgactctgtgagcttcccattttttgctatcgaatatcacaggtaaaaggcaccccacaagagagtatctggattcctatcattttgaagaagatatgaacagaaaagtggcagcctggatgaagcatatcactcggagaaaagtgaagaagacaggcagctgcggatctttttcagtggggcagaagaaaagcctagaaaaaacttgtatggaggaaaaaatgccaattgcctataacgataagaccgggtaatagacatatgtttttccgttatcacccctcattttgagacttctatgttcttcacacaagatgtgagctgattcagaccataggattcccaaaattaagggttgtaatgcattttcacaggtctctggttcacgacctatcccatttatataccatcacacaacatcactccaaaggttatcacgtagcgtccctaacctttcgaattgtattgggattggatttatagctttaattgaagcgagtgcaagcgcatgtggcgtgcatatatatatatatatatatgttgaagctggagaatcagctgctagtcacatgaccgaccattacccggagctaaatggcctttggctcttttagctccgggtaacaaacagcagacaccacagtttgtgtggcttcatcatttttttcgacaattctgactaatttcacatgagcaggaaactgatataaagattagtttttttcgctattggaagtagagattgcttgggggattttcggtgatgatttcacattttgacacatttcacgtttgggagtggtttcttgtctttttctcgaacttagcatatgatttttgcgttctgattacaattagggtactgttttgtatttttgaatgtgaaaaaacactagatctaagcaaattcaaatcaaaagttcactaaattcaaccggtctaattccgcttagaatattatttatatcaagacaggatttctttaagtccaactttcctaccttaacgtttaaaaataaagattcaactctacgtttccggtgaggttttttggtttgggtttagtttctgttaaaagtaattcaaagaccacgacttcgatttcaacattacgaaggatctttcaacagagaggaactcaacttccatagcagactcccgttaaatcgtttatctcttcatcgattcactcaactgaaataaccaaacaaaaattatacccgcaggatggctacttcctgtgaatcgaccgttttgaaacctgatgggaagttaaattcacatgtgaaaattccaatagcccatccaaggtcttcatcgactatcagattcgaccctccaaagacccatgacatggtaagatcattgttcgatccaactttgaagaagtctttcctagaatgctgtatcaccgctaccattatcggtaacgttattctttgctactatgcttatcagcatctcggtgctaataccacgaaaattatcttcttgagtcagtacatattttggagattgtcctacaacttgggtatcggtatagtattgcattaccaatcccattatgaatctttgacaaatttcgccaagaaacatactttgtttgataaaaaggcgaacaaccttttgtcaagatttgttaagttcgagatcagtgcaaaataccaaaaaggcgactctttgtaccgttacccagaagaatggaacacttggctcttgttcagacagtttgtcgatttaatcttaatgcaagattttaccacttacatgctttacgttgtgatttctttacctcataacgatattctcaacaatatcactagcttcaattctattggtatcagagtttggctcggtgttttaatggtccttttcaatatttgggtcaaaatcgacgcacattcagtggttaaagattatgcttggtactggggtgatttcttctttttgcaagacgcaaaccttgtctttgatggtgttttcaacgttttcccacatcccatgtattctatcggttacattggctactatgggttgagtttaatctccggcgatcatcatgttcttttcgtttccattcttggtcactgtttgcaattcttgtttttgaagtatgtggaaactcctcatatcgaacgcatctatggatctgattcatccgacgaagaggaatcaattgatgataagatggtcaaacaattagataactattccaagccattagtcacaacattcttgggtttcaaaaactttgacaagtttaaaccaactgattatatcactttaatcaccgtggcatcaattgttattgggtgcacaattttaaacccaagctttgtcactttatccaaaattgcgttgaccactaagattgtgtcatctgttatcaatatgactatattatacaagcaatcgaatagcaaatggttcacctcattatacttgaagaatggatacaatgaaatttatgcttatcaaatgtggcagtttatctacaatttacacagcactatcaattatattcttttggtattgcaatgctactaccattttgtcaaatgtgactcaggtagttacaatacaataacctttgggttgttgttgttggctattcaaatttggtgcaacactgagatcttccatagtattaaagaatttggctggttttatggtgatttcttcctacctaatttaattgacaaaaggaaattgaagaacgatggtatttatagatacttgaataatcctgagcgtgtgtttggtgttgcaggtatctgggggaccgtcttaattaacaatttttcaaattggaatctctggttagccactacatggacgatgttcaattggttcactgttaaattcatcgaaacaccacatttgttaaaggtttatggaaccaaaccaacatctagtggtttcgaaaagactttgaccaagtacaaatttggtaaggatttcaagagtttaatcgataaagttgatcaattgctcgatgattatttattcactagtctagtgccaaaacaaagcgttgctgaagcagatcgtgagggagattgggaatcgattatcaatatgcttttgattagagagcaaacggtgaaaaatttgcaaggcaccggccactttaacttggatatcgtcaacatcaatgacgaaaatacgattcggattccagaagaaatcgaaatcaaatgggccgttaccaatgaagctttccacaaagatgactggattggactttacaaagtcgttgaaactggtgaagatagattaactacaaagataccatctcaaggacattggtcggcggtatcttcgagctcttcatattctgaagatcatcagaagattttgcatttcgattcaaatgaccatttcacttatggatctataaaattcgataagagtatcctttgctttgaagaaggtatttatgaatttagataccacagtgctaacagtcacgatgttgttatgatctcgaaacctttcaagttattattccctcaatttaaagaaactgtaaaagacgtggaccaattaattgctaccacgaagcagttcttgaaacaatgtggtgttctaatcaatgataataaatttgatttgaataggaacaaatatttcactgggaaaacattacaaaactggtataagtctactatggacaccgatgtttccgttgtttacatgaaacgtaccaattttgatatcgatattatcaccaaaaaagtatggcaaatcaagcaagtgttagataacttggaataaatcgcattctattgtacttaactatatctaaagtatcaacccatgtataaataggatatgtttctaacgaatcctcacccttaatggtaaagccttgtatatttttattttgctaatacagaagaagcgttcgtgtcacattaattatgaatcactatgaaattacgttaaccatttcatttcatttaagatattgaaccaaagtctgcttatttaccaaatattttgccttgcactcttctattaattttgatatgtcagtgacgttatcgtcatcgctccaaataccgacgatttcatgtccattcctaataaacgcaaccacagagttatcttttgacccggcactcactaaatcaatgatttcaatacctgcgtctacaagagccatggtaatagaattaatgcatgtgggtagaatattaacgatatttgcctcctctgttggattactattagaatgctggatcaaatctataaagatatcaataccagattttggatacttctcaacgtttatcaccgcattaaagacatttgttaggaaagtacaaatttctttaatttctccggtattcaaatgttctaacgtaacttctttgaactgaatcgatactgatgccttagattggaaggagcctcgcaatggcctgggtccgaagacagaactcattacgagaacttgatccgaagtaccatccatatattctaggtatgaggaaccatttgcattcgttactaaatccgtactaatgaacacagattccttacccgatttattaccattaccatcgtccctgttctctacggttcttacaggagtaattgcagcaaactgcaatggcttcgcttctgctggccctaatattcttcttctatcttgcacactcattaatagacctctcttctgtgggtattagtttaatataacgatgggaaacaaactcaagtaaatatatgctgatatggcactagccaacgtcaacttggaagcatctcatcgcatgtatattcacttgcaaaacggtcactaacagaataccacgattgaaatagtcgagatggaaaaattctaacgtcatcacgtgataatatatatgtgtttcctatttgtttcccgtttgtttccgtaccgtacttgtttccaaattatcggcaggcagcattggaacttttttacaaatcaaccgacgatcagtacgtgtgaaatgatttctaaacagaagaagtggctgtcgcccggtattgtcaaaccagtaaatagtaatagatccgtatttctgaaaaagagtcgtgtactagctttcggctcatcacctcatacgtcagaaggaaacggagagaactgctttgtgaagttatataaccacgtgactaactggtgtttctcatatgtttctcatatgtttccaaacagcacttgtttccggttcatgccaggtgaccgttttcgcaaaccggtggaggggcagacggagacccccccctcacaacctgggatttggcaactaaaacaccccactctaacccgccttgccagtcgtacatacaaaagccagtatcgtttctgggtgtatcatcaagacaaagtcagaagctattcacttggaccagatcgaaagccgaaccctcgctaatgctctcaccagaagctctttcatgcataggtttcaagaatcaaggcaagtcattcgttcattggttgaaccaccgaagaaaaggatgaccaaagtacatttttgaattaaaccgactctgttagtgtaacgtttcttccaggcatctggcagaaattataaagatttttgatattacaccccaccaatagcccaggactctgattaaaatcaaactactctgcgaatattgctcaaagtctaaccatataacttggaatgtccattgattcaaacaagttgcagtaggacagaatatcatgaatgacagttaacctacaatcttttttcttgaacaaaaactaacaatctaagagagattgaatcgtaaaaacaagaacatcaaggcagaaagccgttgaataaggccaacatacatctttacatagggaacaacgagtatattgaacttaatgtactatctcgtacatacttcagaagagggaggaaaagtattgactaaagttacggcaatccaatcttaaaaaatttgatgcataagttttggctctctttgtaaggaaacctttgacatcagatcgcggtagcattacgatgctaatcgtagaccagagtgatctagggtcattgtcatatagcaaggcggctgtacgggagctgcaaaaagaaaataatgcttccaaccagagtcgaactgatgatctccacattactagtgtggcgccttaccaacttggccatagaagctgttattctcttgaagtcccgttgaaaaccacctgtatataatgaacttacgtggcacccattttcctttttttttttttttttgttgccattcatttcagttcacaggcttacagggcatattactggaatagtttaacagtataagaaaaatatacagcatatgatcagcaattcccataaatgaaacatcttccgtagactttttcttgaaatgagattgcaaatgagtatacatttcagatcaaatctttcttgatcataatcgacctttctgttcgcatgtttacctatggaaaaaaacacaagtcatgtgactctgcccactaattccatactcttgtgttaccgttggaatcttcgtattactattctacctaaacatctaatactaaaaccttcaactacgccggtagactcgaactatctcatttaaatgctattgttttacactcctgtttgcaagtgctttactattttattctccaagagttaaccaagatgtgttcggatgtatcaacattacccttggcgctatccgtcatacatcaaagctcgaatgaaaaagaagcctctccataattaaaaaaaaggattaatcacgtgacccaatttatgaacaagccgtcgaaaaccaaactctaattttaaactatatttaccaacagcaactcttatgtagattaggggaaaacattgcgaaaaggccattatattaagttctattagaccacaataacataccagaagaaaaaacatttactcgttaagggaccttcattatgctacaaacaatcacccaaaaccacaaacttttgttacgtataggagctgattctgtgaaacctgttttatataggagtacagtgcggaacaactcatggtggtccaagataatttatccgttcacccaggaagagaacatttcaccatcgcaatcatatgtgaagacagggaagaatcagtgttttttacctatcaggaacgacaatgaattgaatgacgtacttcttttcaacaaccgtctccccttaatcttaaacttcacctttagaggaaatgagacatgtaataaattaactggagcgttaaacaggattgtacttttagaaacggataagagaattaatatctgtgatgtggagactgatttcctagaaaccagagaagcgatgttacggtttggtgtcacacagatcccaaccttagttgctgtgaggaaaactttcccggtagatacattcactcaaccggatctcacttctcaagatgtgaattggcttcagttgaaaacttggatcgagaagaatgccgatgaatgagcagaatattctctcaaagtgacagttcgttttactttccagcatgtatgatctgtaaaattaaagatgatggaatttttatgtatcggaacatccgtctaaaaaaagtcactctaaactgtattggctaggctgcttctcagagggtcacctccaaaagagtagaaattcccgtcgatatgtgatgttaatccatgttggttatttttactgattcaaagcaaatttaccgctacctcgagctgctaatgccgtttccatttcaacatatttacataactgcgtccaatactaaacgtattgtataatcgtttaatttaatcaggaacaatcggtttggataatgcatagaattgagtcacgtgaccagatgatccaggaggcactttctttctgttcgacaggaaattctttgaaggtcaaaatgcattaacctgtttcaccacggtattttctaagtggactgtaaaagacctcccgctagatgagacaactttaaagtataaaatgtcttctctattctccctcagatcgacagagggtctaactcaatagcagtcagtaatacctcctattctaagtatattcatgttgcacatagaaaacaggatatgtttagctgctgattgccatttatacctgtgaaaagacattagattactccagttatccaataataaccaatacattggaattaggttgaacataattctaccagatcatcttcagaccgcttttctatccagtttgagaggtgtgtcaattgctcccatacatatatacacatttcttttttttttggatcgaatattcatatgatatttagttcacaagcgcctttaccataaaagatccaaaatcagggcagatattccccttgaagagttctaagtagtattgttcttaactgacttctttatggcgtgaaatctacgagctggtcgcagatttgatccaaatgacagtaatgacacatctctatttttctttttggttgaatcgttccttcttagtcacgtttatgaaaaaatcttacaaaaaaaaaagtcgaacaaaaattgaagtggtattcgatgaacaatttaaacagtagataacgaatgcttcgaaagctttatgtatcttaaatattattagcctaacccttttctgtttgttcttatttttttcttagcagtaacctctatcagagaaaccaaacgaaaccaaagttaaaatgtctcaacctcacgaagttgctgctgccactgaggccgtcgcaaatatgcatttggacgaacttactggtgaaatggtctccaagtccgaattaaagaagcgtattaagcaaagacaagtcgaagctaagaaggctgccaagaaggccactgctaaaccaactcctgagccaaagaagaaagcaaataccgatgcttttgctgatttggatccatctcaatacttcgaagctagatctagacaaattaacgaattgaggaagactcacagtcctaacccatatccacacaagttccaagtttctgttactttgccagaatttttgtccaaatatgccaacttgaagcgtggtgaaactttaccagaggaaaaggtttctattgctggtagaatccatgccaagagagaatctggttccaaattgaagttctacgttctgcatggtgatggtgtcgaagtccaagttatgtctcaattacaggactaccacaccgaatcttcatatgaagatgaccatagtctaatcaagagaggtgatatcgttggtgtcgaaggttatgttggtagaacttctccaaagaaaggtggtgaaggtgaaatttctgtctttgtttcccgtattcaacttttgaccccatgtttgcacatgttgccaaccgatcactttggtttcaaggaccaggaattgagatacagaaagagatacttagacttgattatgaataaggatgccagaaaccgcttcattactcgttctaagatcattagttacgttagaaagttcttggataccagaaactttatcgaagtggaaaccccaatgatgaacgttattgctggtggtgccactgcaaagccatttgttactcatcataatgatctagacatggatatgtacatgagaattgccccagaattgttcttgaaggaattagttgtcggtggtatggatagagtttacgaaattggtagacaattcagaaacgaaggtattgatatgacccacaacccggaatttaccacttgtgaattctatcaagcttacgctgatgtatatgacttgatggatatgacagaaattatgatctccgaaatggttaaggaaatcactggttcgtacgtcatcaagtatcacccagatccaaatgatgaaactaaggaactagaattgaacttcactagaccttggaagagaattaatatgattgaagaattagaaaatagattccatgtcacattcccagccggtgaccaactgcacactgctgaaactggtgaattcttgaagaaggtcttgaaggataacaagatggactgtgctccaccattgaccaatgctagaatgttggacaagttggttggagaactagaagacacttgtatcaatccaaccttcatctttggccacccacaaatgatgtctccattggctaaatactccagagatcaaccgggcctatgtgagagatttgaagttttcgttgccacaaaggaaatctgtaacgcttacactgaattgaacgatccattcgaccaaagagctcgtttcgaagaacaagccaaccaaaaggcccaaggtgatgacgaagcacaacttgttgatgaaactttctgcaatgcattggaatacggtttaccaccaactggtggttggggttgtggtattgatagattggccatgttcttggctgattctaacaccatcagagaagtcttgctattcccaactttgaaaccggaagtcgtcaaggaagaaaagaattagcaataatatattcagacaagcattttctttaaccaacaactcttttatagtattatattaataggaatatcgatttaattaatgcgaatttataaattactttatcagctatttgcatatttgatagacatgaagtatttttaatggattatgacagagattaccatggagatgctatattgcgcgagtcattttacctctacgcttcagctcgagagcttttttatagggtgggttggtaggagactgtacaggatcaagtgctggagtcgaagtgtcaacatgataagtagcatcgctgtcaaaagatgaaaggccaccgcatgcaatgaaagtggcgatggaccttggttcttcatgatagttgggacatttatcttcaagcctgagtttaccgatatcgcatccctggaagaagtcttctactgaagaatttacatctaattttggttcccagtttgctggtggattgtaaccaaggcagacgataaatgattctaatgatgttcctcttgaagatcttggtttagcgcaaataactttctcaaaaagatatccaagctgagaatacaacatgtctatatctcttcctctaaatattttggcaacaaaatttccaccttttcttaacaaacaggtagatagctgtaatgcgcttaaaattaactgctgttgaacatactcgtctaaatcgtgtaaaccggtgacatctggcgcaccatcgctacaaataaaatcagctttcttaccctcaaaaagctcggttatggtttgtagagttttaggatgtgtaatatccgcctgtaatgtgattacattatcgatcggtgacatgggctgcaaatcaactgcaacaatctttctatctgaattatctgaactctgaggaaatagtcttctagacaagacctgagaccaagatcccggagcagcgcaaaggtccaccactcgtacagcctgctgcaaaaaatgaaagtcgtcgtctaactgtaataacttgaaagcggatctcgcacggtatccttgttccttagcctttctgtagtacagatcacgtttatctttactactcttccccattgttttccttttgatgtcttgataagccttacttaattttccgtaagtatatcggtttacttcctaaatcgaaaatcgccttgggtcgccttccactgaatacttaactactcgcgacagtttatcttcatttaccgcttctatcataaaagctgtaactggatttcagttttcgaagcttcaaagcttttgacgaatgttgaaaaattttaaagtgatacatggttttaacagtgaagaaagtataagttcgatcgaattaaagcttatagcgatcaatccgagtgtctattagcgtgggtagtaccagtggataaatttagtatcgcatagaatgaacatgttcaggcaggctgtacgtagtttcgtgaggtaccaatcaactacatcattaaatcctaaaattcttccattcaatgccaaggagactccaatcccaaaatgtgtggaagctgtgtaccatgcaccattgaagatcgaaccaacacaccgtgatttgatagctgatatccaattacgttcatatgataatgaaaatctagactttttctccagttttgttctaagagctggttattatttaggaattccaatgaaagggccaaaaccactaccaacaaagagaaaacgttggactgttatcagagctccattcgtgatggctaagtcgaaggagaactttgaaagacatacacatgctaggttaatccgtctatacgattgtaacaccgaattggtagaaactttattatcatatatttccaagcacggtatcagtggtgttggtatcaaatgtaacttatatcaaagagaacctatagatttggacagtaaaaaagacggcccggagttggagaatattgatatctcgtcccaacttcaaggtctggatgacgttgttggtgctaaggttgttgaattattgaacaatccagaattcaaaaaacatttgcaataaaattccagtccgaacgactggcaccggtccagcaaaacaacatgcacatatctataatttcgaaggcctgtatatatacaacaataaataattcaacgagacgtacccaaatctctatcacatatattatgtatcgatttatccgtacatattgaaatcctcctcaagttcacattgagatgtgtcaatttcgactttctttgacctgagatcatctctgcacatgggacatgtatggttgttctgtagccatatagataggcactctagatcaaacttatggttacagcgaggaacttttgccactaaaggatatgggtcgtcgaggaaattgcactggcatatcgcacatgtgtcttctgcctttaacttactattgggcaccctgggcagtgagtctatataagtttcagacattcctttctgctgatcgtcttgatcaaattcaagagttgaaccaagcaattcttgtagtgctgctatactatcaacggaaaccggttcatttgaaagataagcacttctcaacaaactccgtaacgcctgctctggagttgacataacctagtaaaatatgatattgaacgtatttcacgaattaataatcgtttactagaaatttaaccagactctcttttccctgtgttagtccttgacaaaagcgccaggttaagatcttcattaagaatgaattaaggtctttactttaatctgtactttcggaatcggtgtttaaactgaagagacaaagaaaataaaacaactgataaaagcctgatgaggtgtatgctctgggaacgtatattggttgttcccattctatttggtgctaattaagatgtacctagcgttacaaggttttatatacggtcagtattattattatgtggttgtatttcttttttgtgcattgtattaagttttgtaattattaggaatcatgattattgttatgttcataatgggttaaacatccttctgtcccatattaggacatcagcaggtttgttcaaaatggtttgtgttcctgtagagcttccattgaatctaattgacatcgaaggataataattggaaatgtcttctaccaaatctgtttcgatgaagtcagcatctgctcctgtaataacctgagcattacccagtgcacaagtagcattttcttttatatagcctatgctgagagatgttgctttcacaagttgtagaataataacgaatatcaaagcaatggataggaaacgtacattaaaaccagatttttggactgcttcttgtggcatctgagtcggcgagtctagaacatgcatttggaaactgtctacatcttcgtacgcatatgtgggactgccaatgagctcagctgagaacattggccaaagaaccatttcgtacaattgattaaatgcgaatagaaaagagtaaaacaaaactccaagtgaattcataagtagcgaatgtaataatatttgatgttagaaagtcttcggaaaaagcaaaaccgaattgatggtcacacagagagctctggaaaatagcaaatattttatgaatgcattggtgatttcagatacacaatcgaccgtatgcttatatttatattaaaatacgactttcaagtgacataaaagaatgacagcctgtatttacaccacacgtaaggctgtcacaacaaaattgtgtttcttgagaaaaatttcaattgaaccctccgtcacaaatccagtgtgtgtctgcgacgtgaagacttagacttagtatgtaaatcggatttagatcccgattttggtttgccctttttcttaccaggttccgtacctattattttggcatcttttgtaataattttctgtaccaaacgatcccattctggttctgagttcacattattgacatcaaaatcatctgatagacaagatgttatatggattctatttcctttcatcagaaggtaacatttctccacggtgggtcccactttaaactttggtagtatcgatattaatttttgtgtccacaaatccggatcttgtttgaatgttaaagttgcgatcctaagtttcgaattcaatttcaatgacgtattctcacgctccaaattattattagtagcgactattagctgggaaacaatctgagactctgtcagattagggtctatattgtataggaaaaatgtatccttggtatcgttgacattggagttaaacggcagttctcgaactctccacttccgaatggattctgcttgtttcaatttatctatattcaacggtgctacttgttttgagcttagtccaatgaaccttttcatcatatcattcttcggaatcactgaatccgcattctcgttcaacaattgtttcatcgaattccttaaatgcatcggtattccatgttcgaagtcgttcaaacaaacttgacatatcagattcttcgtagcacatttaggacagcatatggtatgaaaagttgtgtggtttattgtgtacgagtatgaatcgaatgggaaggtacaaaacttacattctctaccattggggtatcttatcaaagttggggtgttttcccctaatggcaaacaccgttcgcaaatcttcaactccccagtatcctgactcatgttcacctgctcgttgtgctctgctggcagtgccaccgatgacaagatcaacgaactcgacttatattaatcagatttctttgataacatctcatcgcattggtactattttttttcaaatttcttttcattctttccatagtgaaagtattaccttgcaatatgcagcggatacttaattacaaaagagagatgagctttactaagagttataagaatacgcacatagaatattagagaaagtgcgatctagcagaatgtaaaaggatcagggttaaaaagctatgtcaaaataaggattcctcatgagttgatcggttgaagaaattcatgttgttgttgttaggtgtatcatcataaaaagtttactgtattctgctttctcgacactttctcttagttgcaagtatatagattagaagaaggtaagatttccattgatcgcagtgagcaatgaaaatatatcgaggcctctcgatatttgtatccttggtgtctttcggaactgctactgagtataataaaagtaaaaaactggttatcatcaagtaaccttgagtctaacttacagtgacaggaggtctctctcttttatacctgttggtaaaaattttcttgggcctgaaattaacaaatgacacccatacactacataatgaaatatccgggtaacaatatatgctctagtgcttatttggcacaccaagctcaagaaacggtacaattttgtatggaccatatagattgtgaaggttcaacatcagccatgaattagggcaaagcgtgttatataattacacaaaaactatttagagaactaaatgccaaaacgtttttgatacgtaagatataaagagagcaaaggcaaattcatagtgacgagaggtcaaatttcttagtctaattatatgtgaggtttaactaaacttaaggttggtaattacctaaaaagaggataccatggaagattttaatggtccaaatttcaagtaagaatgatggatcactacaacaaaacatagagagagtatttgctgtggtgatgatgcaagcagtacacgtttgggtataatacacaagggagaaaactttatgaggattttttttgtttaattggttttaatctgtatcctttggaagcgtcatggtatcaagctccgcgtatttattgaaggctgttgttcctcgggcattgggttattcttgaaatgggttctgtaatgttgtatataattatcgtgccttgagaatcgttgattacaaccggggaactgacattgatgacgcttctctccggtatgaattctgttgtgacgggcaaggtgacctgatgtagtgaaccctctggagcaaatcttacagatgtattttctcctttcagctaatggcaagtctttagtgttcgactgtttacctgtgttggagattttatgctgttgacttgcctttggtttacggtcttgccgactagaccttttacttttcgaagcaattggagtagaatacgaagaagaagaaggcgaggttgatgtggaagagttcattgagccagcaatgttggagcgtggaatgtcattattggagattacgttatttttccccgaatccaatgtctctacttttacatcatcaccattggaaagcgaagaagtcgagctcgagaaactgggcttttgttgatgagtgggagggagtaaaggttcagaaccaatgaagtaatgaccttgacttgggttatgaatttgagtctgggtttgaacttgattatggtctggtcctgtgaataagaacctatctaatgatcttttggcttgtagttcggctgatgctgtaggaggtggaagaactaatggtaacaagggtgacgatcctgtcgccatagaagaaatagatagtgatgatgcagtagatgatgaagagtgtgtagcccccatcataggaggaaccccataagggctatggatagccatatgcagaggtggtagaaccggcctcgaagtattttggccaattgtggaagccactatgctatagctttgatgtaccggtgctccgtattgatcatgaacgatgttggaattagttacattgttcaagttaccattgaaattgatattagcgtggatattatcagtagcggagttattacagctattactgctggaaccccatgcaattccactcgttagtggcattttttgttcgacaacagacataatcttgccgatcagctcttctctgattgaccttaaacttgtatttttgaaagctttggctggtaccttgtcttctggctatgtgaaactgaaagaaccaaaggcaaaaaaaacaaagaggagatagtacaataaggagtggatctaagttttcaagaccctgggtagaaccatgtactgtaaagctgttctatagaagactattctctttctctctgttagactttactcacgttaatgtaaagtgtctccggccggattaaaagcttcagaattaggaagaaggaagataggatgatgatataacaatttaaaggaaataatataacacaaaaacccttcttttgaaagacttgaatgtttgtaatgtaggtaactacgcagaatgaatgaaaaacctaaccacgaaccgataaaggacgtaatgattaactggacccaaatcataaaaagcatccacatatatatatatatatatatatataaactgatcagggccgagagataaacctatagatacgctgtgcctagcacaaaatatgtgagtatctccaaaatgctaggcaaatattgagcggtttttggaatctactttttcttttaatagagaaatcagtacccaaagtcatgtcaaaaaactgtgccttgcccacatttcttaaagacaggtagccatgaatcaagtgtccattccctttcttgctcatatagaggaactatattgaaggcatgctaagacctaagaatccaccaccgtaaaaactccattctacatactaaaatcaaaggaaattaaaaagacaaaaaaaaaaacaccgaagggaaaacagtgtatgatcctttggcaaactccaagaacagctcacagcatgattttccctaattcctgcaaaaaaagagaggaaaatgcgaagatccagtgggggccgtaacaacggtgtacgagttattcctttgacggcgattagtaaaatattagaaattctacacaaaaacatggatagtttgttttcttctctcgagcgacgtttgtttccttggtgggtttaaggaaaaatatagccacgcactgaaaactccgcaggacgcggagagggcggatggtaaagtttacgttatttcgtacgtatgatcggctgaagcagttatgtttcaagttccttattccttacacctactaaccttaactcacaagcctcgttctcattcttgattcttagtcaatgggcttaggaccccgtttaccatacagaattagtgttcttggtggtggacctacccccagccacctaaccacctagccacgcattgtaaccttattatttcttaactatgagagattttatttcattttcttaaaactaaacctgtacgaaatgggaaacaaagcaaaagaaaaaaaaaataaacccaacttcaggaatagattgcaggaattggcttttctcagtagataatttcttggcaaaatgtcatttccagtgtgcatgtaggtatatgttgtagctacgtattcttttttttagacaaatatgctcctggtcatggttatctttaaccaatacacggcgagagctgattactctgtcgttaatgtggagagctgtgtccttgtatgctcttctggacaagagactagatttccattctggcaatcaatgacaccgtgctccagaagacggaaaggagaatgatgtgtctttgtttatctaagaatgctcctacgttcttatctaaagtggcggtccctgtctgggcaacaaaaatcgatagccaaagagttgttccgggagaggtctagatccctgaacagccaaactccattttctcacatttttttgtgattctgcgaggaaaaagaactcaattcagctttctttttcatttgcgtcgcacggtgtaatgtgctgtaggtccctgtttcgagaaagtgttgagattaggatggaaccggctggtcaagggtttactagaggaatttttcagttcgccgattcgatgcttaatgctctgtcttggttcatggtcgtggtgggtgtttttttgctcaatccatggaaataacaaccggtatgttgccagaaacgttagttattaaattgttggtagattaaacaatcttatctaagtatacttttggagctaactggtgggcactatgattgaaactagcagttcaaaaggaaacttagaaagaatcagcctcaaagctcggcagtttcccaatcaggggttcgctccactgcctctgtgcgtatattcccattattccttgttaaagaacggaaagctaagaaaaaaacatgcatggttgagtgaggtttcatccagattgaacatggacccttccaatcttttgctttctctggttctttttgaaacaatcgttggcgtttttccctacgaactttctgagcaattctcttacatccgctattcgtagatagaagaatattctaaaaaaaatgtaaaaaacgagatgacatcacttagatgatgtcgtagctcatatgatccgtgtaagtgcaacttttcgttcctttctcaacggatcaatggtaccaagaacccggaacaacttccacaaaaaaggcgtagtaagaatgttattttttacaggcatcactccactcgacaaaagacctagacaatttccaaaaacattccattgaaaagggtttttcttatttttcattgaaatgtaagtgcgattagtttttctgggcgacataccccgacaatattacgaaagttacgaaagtggaaactaaggtgctcggggaggaagaggatttcgaaaaaaggaagtctcggccgtacctgaatccgaaatcacatatgtttatccggagatagttggatgcgcaattctgactggtagagaaaagcatagggaattctaggcagtgccatggttatacgacaacacgacaagtacacctgatatcccttctcgaagtacaaagcataatatgaccgaaagtgagagtcttgggtgtgcatattgtgcaacatgtttacggtggcttgggggaggctgtggttgtattaggaactgttggccggctctctcttgtggaatgttcccggctcatagatcaaaattcatcaactttctattttcttacgacgaagtttgttattattttttttggcatggaaggaacgcgatcttcagcttgaaataagttatcactgaaaaacaaagccagtagaaaacatgagcacagtgtattctttgactctcacggctacattacaagaaatgtatctaactgtatggagctaatactatttgataccatactaccaaggttcatgttaacaagctagtaggtctattgttttctaattgtttctgtgtatattgtattccaatcggcacttacgtggcatacacggaaagaaaaccaggaagaccctttttctctcatagaaagtcatgagaatcataaactgaaaagaggaacgatagggattcgaaccccggcttgttactgctcacctgtcaacacgtgatcccgacttttataaaaaagcaaaaaagcggctactactcatttctcgaaacttttcagtttgcatgaaccctcgaaccgcgcgctcggttaccacaaacacatcacctaatatgcattagcctaagctgacataatcaaaatttcgtatcctagctgtcattcatcgtaactgccaacctcgtattgataataggcacggtactccgagcatatcactcgatagccttttcttgacccaattttactcgctccatcaatgtcgtatcttgaatgtatgttggttcagcctctatttctctcgtagatagtagtatgttcgaatggttccacttgacctttttttttcagtatatacggtttaacactaaacgaatgctgacgcctatgtctccgtttcagaccataataatgatacagtagtgtattatattcatcttgtggtgctcggactgccactattgtgatgagattcttgtatctcgtatcttttcctcttcctgtatgcggtggaaactagctagccttttttcttcaattacctttatccaaattatcaccaggtctgaatcttgaagtctgcttgctttttggattttttttttttgactatattaacgaaagtgaattattccattcgactcaccaactgaaatgagaagagaagcattggatctatactgcccttttctctccaatcaagcagaatcattgataaaactttacatccagtatacttgtctggtaaagcaaacagaaactcaacgaccggttcatcttaacacacattctaaatattatcattgtgcgatgacagattcacaagtgccaattagagagagaatggaggccttagtgcgccggaaacagcaagaaattaccaagggtctggaaactttggatactgtaaagtttcaagccgattcttgggatcgtggcaacaacggtggtggcggtgtctcgatggtgttgcagaatggtactacgtttgagaaaggtggtgttaatgtcagtgtggttcatgggaacttgagtccacctgctatcaaggctatgaaagcggaccacaaaaatttgcatctgcctattgatcctgcaactggtgaaccagatgcaacaggagtaaaattcttcgcctgtggtctctctatggttattcatccaattaatccacatgcgccaaccacccatttgaattataggtatttcgaaacctggaatgcggacggtacaccacaagcttggtggttcggtggtggtgctgatttaactccttcttatttgtacgaggaagacgctaaattgttccatcaattgcacaaggatgctttggacaaaacggacgttgccttgtacccaaaatacaagaaatggtgcgatgagtatttctatatcaaacacagagaagaaaccagaggtatcggtggtattttctttgatgatgtcgatgatcgtgatccaaacgaaatcttgcaaatggttgaaaactgttttgatgccttcttgccatcttacctcgaaatcatcaaaagaagaaaggatatgccttacactgaagaagaaagacaatggcaacaaattagacgtggcagatacgttgaattcaacctagtccttgacagaggtactcaattcggtttaagaactccaggatcccgtgtcgaaagtattttgatgtctttgcctgtgactgcttcgtggttgtatgaccatcatcctgaagtagactctagagaagataaattactccaagtattgaagaaccctgttgaatgggtttgaatgcctttatttatgtaacgtctcatgtatttaattcttagtttctaatgatcttaatttcttacgcttcaaaaaccaagtcggtcgttagtaccatacagcgttgcacgaaatggttctgtcaggccgtcgacaatacttttattttgtcttgttcaatctatttgtagatttatacattatattacactttgattcagaagaagtttcatcaaaccctaacaacttccttttgcgagcctaatgaaagcgtgatctacctttcatcatttgaaagattaagcatgcgtttttagctgggcgagagacaaatggcagcgattaaagccgaacatttatcttcttgtcagttttttgctctaagcgatgtaataactgctaagaagatctataatattttgtttgatgcgtatcgaaatcaaagtaaatttcaaaaatacacaatctctagttctctctccatttatgaccacagttaacacatttgtagaaagttgtcataggttcatctgcagatctgatttgcaactggaagaagtaagctctttcacccgcacattggtcatggttcggacattgtgctgctgtctggtcaacattatcccatgcaccttctccacctaagacatcatcaacttctttcctagggaggttctttctatcgtatacctctatcccatcaattaaaaactggtatgggcatgatccgcatgctagtttatacagacctgaatcagcttttgataccaacaacatgttattgcataatgggcaaaacgaaagcatcctacaacttaattctcaatgtcagactcctcaaacacgatacgttaacgcaccgttacctgcccataagctccttcaacacgttatcgcatacactctaaaatgaacctcatcgctataattattgagagtaggttttaattctttcctcatctcatatagaaatttttcagaaaaaaaaaagtagagcttcatgcctttaactttgaatcgatatttatgttgacatttaaggtttgtatgtcaaatatagtgtatagggttaatacctgtgggcgaggtttgatagaagaacaactcccacatttataagttagtttccattctctagactttagagtatttgattatcttggagcggttaaaccttgaaaacatgacgaagaaagagtgcagtgataatgaggaagaagaagaagacattgatattgtaaatcaccaagacattttcatatcaccttccaaagtaagatatcagtcaccgaagaaacttaaaagttttgattttctttcgccttccaaaacggtacgacctaagtcacccaaacgatcgctcacattagagtctgttagcattgagactgaatataaagatgaagagagtaggaagcactcatcgacagatactgcaactcccaggcgaaggcaaaggaaaacaaccaagagggtgaagttggaggaagatgatgccattgactatgtgtcagatactaatgaattgatacacaatgacgacgaatacgaggatctaaaaattaaaatagattctaatgaaagctcacctaataagtcgcctaggagaaaacttacatttaatgcagaaccatcaccccaaagaaagactaccagaaatacagttcaaaggaataaaattatagacgatgatcttgcatacgacgatatccagcagtataagcatctgaaattgaacttgaaccctaatttcaaaccgactaagttgccaaagagcgataataatgaccaaacatctgatgaacaatctcaaatatattttttcgatggtttcgaaggtttcatagatcagaccaagatcctaaaaactgataaaagatccaagaactcgatgtcctcggcaccaagtatttccagagatgaatataacattctttctcaactttccaatgatatattccatcgttcatcgacaaaggcagtacaaaaaatacatgaaacactctttcagcagtttactttcgagttactgcagggatttacgttattattctatggtatcggatcgaagaagaaattcctcgaatcatttgcattcaactttctttctatgaagatcgccttgttgcaaaacccggatattcaaaaagatgatccatgtataccggtttttgtaatgaacgggtacaccactctctctaagaacatctttttggatatattcaaaatcttagtagagggcgagactattgatgatcaaggtcaatcaaattattgggataatcgaattgacttgcaaatggacaggctttcaaaatatttcaagaaaagacctcctacggtgaagatgattcttttgatacataacttggacggtccgtcattccggagagaacattttcaaaccagaatgagtattcttgcacaaatcaaacaaatctgtgtcgtagcaagtgtcgaccatatacaagctcctttcctttgggatcatttcagagctcaatcattcaactttgtttaccacgatatcacaaattttgagccgtacatcgtagaaacagtacaaaccgataatgctatcgacttttccaaagattcaggtaccttgtttaatgcgaacggtgctaaatacgtactagaatccctgacggacaattctaaaagaatgtacaaaattcttcttcaacttctaatgggacagattaatgccaagaacgagtcaaagcctcgtgcaaaatctagttccttaaacaaaatcacacctgggattgagttctctgaactttttaaaacatgcaccgaacagttcgtagtctcgagcgaaatgggtcttcgaaccatcctatcagagttcattgatcataagatggctgtcaatacgaaaaataaaatgggtaaagagatcataaatgttaaatatagctatggagacatggaaaaaatgataactgagatagattccatgctgcaataaataatccttatttaaattcaccatacatatttatatttatactctagcgttctgatctcatttggctttaccataccgtccaccagggttcatttcttttacatttcctatgctgaatcagttctgcttccgaaaatcactgaaaaataagttttcgataaagattactattttaatgaacttaaggttatatggttaagaagaaaagggagaattcgataaagaagagtatcgtatacactaacagcaagtgttggaagcactgttggtagtggtatttaattcagcagtccgctaaatattgtgatgagcaaatcagacactatatccagaccgaattcggtggcacatactgcggcgacctctgctatgattccgaattcgcatctgttgagtcccaacactcaggttgttgttggcactcataggtgtgaaattttggagcatttagctgagggtgggttcgcaaatatatacaaggtaaaattcttggaattgactaacgagatggatgctggtatcgattccaaactgcttaaggcaggggacatagcctgtttaaagagagtcattgtgcccgatgaaaatggtttaaatgagctaaggaacgaagtagagaccatgaagcaattgaggggttctccaaatatcgtacagtactatgactctaatgcatcaagacatccagatggatctccagggttcgaaattttattgttgatggagctctgtcctaagaagtcattgctggattatatgaataacaaattggcaacgaagttaactgaagctgaaatattgaagatcatgtatgatgtatcgaacgcaattgctcagatgcactatttacctacgccgttgatccatcgtgatatcaaaatagaaaacgtgcttgttgataaggatgataatttcaaactctgcgatttcggctcaacttcaatgtgttttccaatcgtatcaacgcatcaagatattgctgtacttacgaataacatttatgtgcatactacaccacagtacagatcgcctgagatgattgacttataccgctgtctccctatcaatgagaaatctgatatctgggctcttgggatcttcctctacaaacttctattttataccactccatttgagctaactggacagtttgccatcttacattcaaagtatgaaattcctcagaatggatactcatccaaattgataaacttaatcattattatgttggcggagaatccttcactaagaccgaatatttatcaagtcatgcatcatgtatgttctatcctgaagtgcgatgttcctttcactgataaatacgaattgggtccttacgattttgctaaatactctcaataccacttgaaattgcaacaaatacaataccaaatgtttgagctatataaaaatgagaaggtaactagcggagatgtcgataagttgaacgatttattcattcaaaatttcgagatagctccaaaacaaccaattgataaaggtattggatctgtcgaccaacaagaagcaccagaagatctggaaactgatattgctaaaatggacgaatgttatccaactgtggaaaagttagaatctgctaacgccaaggagagagatgatcatcatctgcaagtactgtccacctccctcaagcaatcgagctccagaagtatatcggatctttcaaacaaatcacaagtatcattggattcaaatgaaaggcacagttcacatggtataagggcgccctctccacttccttcgtcacaacagccacagaatactgcgaatatgtcggctgctagacagcataaacaacataatccttttcaatcacaattccagcctgaagtggatgcatctgagtactttgatgcgaacaacgaacaatacttcaaaggcactcctcctgcacatccaaaaaatgaaaagaatgtatcatattttcaacaatctccgatgaaggaaaacaacctaaataacttgagtatccaacaaagtgatcaagcccgtacttttgatactacaatgcctatttctgatgttccaaataatggcaacgtcgtgaatgacgaatacctgattgacatttccccacccagaaataacgtaccctattctacaccagccgcaattacagccaatatgcaagatcaaatcatttcatcgcaacctttatctcaatctcaatctcaatctaaacctcagcctcttcctccaccccaaccccaaccccaaccccaaccccaagctcaagctcaaccgaatacacgagcttcactgaggcctgagcgccagcagcaaattcctgctcaaccacgattagaccttacttttgatcaacttgatctttcaaagaattcattgactaggcagtcagatacagaactagaagaaagcattatatcagatgaaagcatttcactcgatttgaagcagccgaaattgaaggagcctgtaacccaacctcgtcaaacaacatctccagggtctgagagtaaagaatttctgaaacccgccaaagttcctaagcgtcggtcattagacctaaaatatcaagaaatcaatctttcgaatgatgatcaacgtaagcatcgaaaaaataagacatcattttcccgcaccagtgtcagaagatctgtagaaatggaacgcatgaaacatgactccaactctacatctaattctaatgcaagagacgaaaccaaggagacgaaaagaagatcgttctttggtgtattcaaatgataggtaaccaagggtaaaagaaattagttcatccgatagcataccaaaaaaaacaacctgaactgattgaagcaccgatgtccttattcttttaattcaagtcaattattgtataaacggtatgtacacactttgattcttattgtcattcggcacgtctctcgaccttttttaaactttacatttcttaaggttgatgaaaaaccaatatttacattgaagaatataagaacagaagcaatacaggtaaattttggttgatcagtaaacgatatcctgtaagaaggcgattgtaacattgaactaaactacactggagtcaattttgacttatagaagggaatacgctgaagataagaaaaaggtagacaatggctgcagaaaagatttatgaaccatacaagaagtctcgagggactatgatttacacaccgactaatcagcagatgtcgcgtggtggcataggagaaaagttggctgatttcgtgaagaatctatactgggtttattatatccatcttcccttttatttaatgacttcacttgatgcattttgtttacacactatatttctggttgtagtcagcctgagcttatttggtttattgaagtacattttcctatgaaactcgaaattcaaagtttctcaatcgaaacattagcatacagagaaagagggagcaagaccttttttagcgcattcgttatcaacgaaaactccgatctctaatccaatcaacacatatccatgacaaaaaaattgtcattaaattgaagcaaaccatttcttatcacactcccttttagacaagtcctgaaggttcgacaagagtaaatttgtttagaaagtatgggctatataatctataaaaacggataaatatttagaaatgtatcacggttatttcgcaggtgatcatgacttcatatcaggagccgttttcccggttctcttgtgtttgtttttgatgtttttataatatgtctacgagaatcacccaggaagcatgagttaagccttgctttgttcgaactctttattaactcttttcactctattgtataatacgacatcatcgtgggtaataaaatcgtacaagactttacaccaggaggagtgctttggcagatgattataaaattccggacataaactgttcaattcccaaagtcgggaccaagcaacaaatgggaaatcatgatgttcattgtgtaaaccgacattccaagtgaagaagtttagaagcccataataagaatacgtctccaatgcgtactttttcctgaattcgacgtcttctcttgagacgtttgattcatcagtgacgttaattggttgtctttcggctggcgttaattttagcatcagtttaccaccgatgatagcttcttcaatgttcaacagatagtgttctgcaatgaaatggccagagcatggatgtagagaaccggctaagaatgaggacatcaggaaataacagtatgaataccaaccaaaattcgcgatccatataaaattgaacataaattggtacaacacgttcaaaaggtggatgtaggtgaatttgatccttgtgacaaacataggtctaaatgcgtagaagaagatttggaatgtggcaaagaacgatttccccaagatattggataaaagcacagcctcaaacctggtagggatatccgtgtcataaatttcatctccaagaaacttgtgatgcaattgatgatatggtccaaatgacgcactgtatgggataccaattggggtatttgtgaaaatggcaaacaacttgttgtggacaggtttcttaaatgctaggttgtgagacaattcatggattgccaagaagatattctggttagcggtagcaccgatgacatatgcaatgatgaaaaatttccaagtaaaaggatgggtatttcttaagtaataggaaagcgataactgaagcgacacaacaccaatgataatccatttagtcaaaggttcgtggcccataagtcgctgcacttctggatgtttcttaattatggcatgtcttcttatagcatggggttctttatgtgcggaccagtagaagttatcaagaactttaaaatcctcatctgcacttggaacgtcgacaaatttctcagagactttcaaatctctatgaacaattgtcatgtctaagggtcttaatgaagctctcttcttgttaagatagcgattccgatgctatatcaaaacttgaaagtaaaacaatgccgataaaaaaacaggaaccggaaacacgcttgacaaaaatacagttcttgatccttgattccaagcctgcctagaatcttattattgagtttgatactgatattctcaatgtaaccacaccagttggatcaggtataaatcctatgtttatgcgtgactatttaaaagaacttaagcttttaaaatttaaaatctaaaatccttaaatcccgaaaaagaactgatcttatgatgtgataaattcaaacacatacacaaacctaaacgcaagcaaagcctgctaagaaatgtggtttatacttagaaagaaatctgtaattggaattacaatatatctttaaacgaacaaaaaccatgcgatgagatgttgctgttccgtgtgctctcgagcgatagaaagaaatttttcattacgctttaagggaaatgggaaaaagtacggtcacgtgaaacaaagacacagagagggaacgccctgttctaacatcagacacagggttggtggtaccaagggccccaccaatatctgtttaaccattaaatatgcaaaactgatatatttcgatccaatcctgacatactctaaatcatttcaaatgtcaaacgatgtgacaaaccgctgcaagattatggttcaatcttatacaggatttgcttccaccccggatgaatgcaattatacgcgtacataagttctgtaccccctttgctaccgaccttaaattgcttcgcagtttggctatcttgtcttattatcccctttcaagttggagaattgctcaatccattaggtactgaaattgttcaacaatcgtagtagctttttttttttggtcactcactattctccatctgctgaaacaaatttgaacctgaacattgagtggaacgaacttgacgagaacagaagaatggtagcagtctccctttaattgctgcatacttaacttacgttgatatctttgaccaaatatatctatatataccgagatctacagcgtcttataatatcctggcgggttatcaacatcatctattatacccatttttaccatagcattccataatgttgaggcattcctattgtagagcacagcaacagtcattgagacacgttttgaagaccagattggctgttaatcaattaagatttatgtctgaagttaagtttagagtcgattccactgccagagtggtcactttggatagaccaaagaaattgaacgcattggatgttgagatgtgcagtgccatcttgcccacattgcaagaatatgccaagagtaccgttaacaatgttgttatcttgaactcttcagctagtcctagggccttctgttcaggtggcgatgtagctcaagtagccaagttggttaaggaaggaaattttgattacgctagagaatttttcaccaaggaatactcgttaaacttggctctagctacgctgaacaagccggtcatctctatcatggacggtatcaccatgggtggtggtgtcggtctatctactcatattccattccgtattgctactgaaaatactcgttgggccatgcctgagatggatattggattcttcccagatgtcggtgccactttctctattccaaagcttaccactgttggtggttccaacggacaattggctcagtacttgtgcatgactggtgacattttgaatggtgccgatgcttacgtggctggtgtcgcttctcattatgtgccacatgatcagatctccaacttacaggcaagattggctgagttacatttgactgaagccacttctcaatcgactaaccgtgatgatgaaattttcgatgttgtcaaccatgctattgaggaattcaacgcaccattaccaagagactacaagttcaagtacactgctgatgaactaaacgtcattgaacagtgtttcgatatcggtaacagtttgaagcaaatctactccaaattggatgaggtcattgctggaaagacagtatcacaaacagctcaggagtttgctgcaaagaccaagcaaatgctagctagcaaatcccctgtttctttggaaatcgcaaaagaacttttccaaagaaactccttcactgacattcaaaccgccttgacccaagatttgatcactgctactaaaatgtcagaatctccggacctatgtgaatttgctgaggccactagtcataaattgctagaaaagaacaagaccccataccaatggaagatcaaagatttgaaattagcccaaatatcagttctaatctcacaaaactcctcaaacccggtgtcgttgatccgcccatcaaatttagttactttctctgaatacccacatcatagcaagtaccaattaccaaacgaaactctagttgagaaatatatcacaggtgctgacaaccatggaagacaaactgcagttactaagaaggaagctgtcaaattcttccaacaattgaaccccgccacgaagagtaagaccggcgtagactacttggtaggttttattattgacagaaaatgtgttccaaacccagatggtttcttaagatggaaaacttcctctgctaaactataaaaactatacatttcgattatatagtacatcgaacacttgtaaatacacttacgattaacctacacgcaataaatttcattatcctctcttagaatggcattgttcttcggcagtacataagggtgccataagttaaatacagctctaattgatgcgttctactttaaaactcgttcatctacctaattctttgttatattttccataattacggcatggtttaaaatttgaaattactggagtttgatcctttaaaatgagtgtgcaagaaatagaacatcaatatataagaacaaagctccacaacgcatcatatctgccttcaaattaaagatgtctggttctgatatccttgatatcaatgtacccagggtcattgatacagatgactgtgtttattgttttgaaacgatgaagaataaagatgagggtcgtgaacattcattattcatctgtctacgctgctttcagtctttctccgaagagcattgggaactacatcaagaggttgttttgagtgagactggttctacccatgatctgtatctcagagtattcaaggttctaaaaccaaaacaagagcgagaagaagctggcacgccaccattggaaaagaaattaaagcttgaggttaaggatgtgaatgaggatgatctatatgatacccactggctgcttggatctgtggaacatggagaattgttatcttcagacactccatctattcctaaggaatggagtgacaaaattagtgaaatcttgcaaacaaaatcctcatcatatcaagatatgtcaaatacctggacacttgaattaaagtcatgtccacacatacagactttcgacttatcgaacttggagaagcgagaaggtggcatttctcaaagctgtaacgactgtggtcttacttctaacctttggttatgtctccattgtggaaacgtcgcctgtggaagagagcaggttgggatagaggggtactctcatgctttgaaacattatgaaagcacagatggccacgctttagcgataaaattgggctctttgacagctgatgcagctgatatatactgttattcttgtgatgaagatgtgaaattcacccataatctgcagttgcaggatatcttgaagttttgggaagtcgaagtaccagccaagtccaaagaaaagacattggtggaattgcaagtggaacaaagtctgaaatgggattttcaaatggtagattcacaaggtaaaagtttaaaacatctacaaaatggtcctgaatacggtttgggcttattaaatttgggcaattcttgctacctaaattctgtattgcaagttttacttaacggtgggatcagaaattggaacctagatggattaggatcctttcctacagatgtcgtctatccaagaacgaatttacactgtcaactaatcaaaatcagaaatgctatgaccttacagcaatccagatatcctgagggtattaaacccaccactttcaaaaaggttattgggggctcgcatgaagaattttcctctggaagacagcaagattccttggaatttttttcctatctctctgataaattggatagagagatatttaaaaatactactaccaatccaaacgatttgtttagattcaacattcaagacaagattaaatgtgacaattgtaacaaagttaagttcatggatcaagtttcagaagtcattcagcttccattaagaaaactagacggggagcaaaatctaattgacaggttaaatgattacttcagtggggaaaaaattgaataccgttgtctcaccaataagaaaattaacactgcatcaaaagtaccagggttctctagtttcccacgtacacttatcataaacccgattagaattgagttaatcaactggcagccaagcaagacatcagagcaagttgtggtacctggtgtacgcgatgatgctttactagatatgtccccattcaaagctacaggaatttgcgaaggggaagaagtcgaagaagaagaggaatcagattccttccaattcaacgaattgttcctaggacaattagaacagatgggattctctcgcaatgctaccaaaagagcattatttgaaacgggaaactctgaccctaatgcagccacggaatggttgttccagcatatggaggaccctaacttaaacgaggcctttgatcctcatgcttcatcctcagcgaaaaatcgtgtcgattcagaagcactaaacagtatgactgctatggggcttgattcgaaactatgccgcaaagctttgatattgaagaatggtgacgtcaatgccagtgtagaatgggttttctcccatatggatgacgacggggagttacctgaagctgaggaatggaaggatcaatccagaaaaagttttggaatcccagcatcgtcaattgcctctgctaagtataaactgactgctgtcatatgccataaaggtaattcagttcacagtggccattacgttgcatttattaagaaagtggtcgaaggaaaagaacaatgggttctctacaacgatgaaaaaattctcttggccaacgatgaaccaaatttcgaggacatagaaaagaatggctacatgtttttcttcaaccttgaagaataagaggcatctcctctctaaataaaagagacatgcatcacaacatgaaactctaaaaaaataggacttgcccaccttcctatctgcattgggtattcaacgatatggttgtgtgtccatatatacatatatatcctcgtacatgactcaattcaatacagtatggtgggcttattcctatttatagcggttcctgtctggaggcagttgtgtccagccattgcaagtcacgtgaatatgcttcatgattccctgaaaatgaaacatgtcagatctgcccttaaaaataaagcaaactagatcaattatttaccagtgacagaacacttgttaccaagtaagtagtcacacaatcttccaaaaacgatcaacaaaccataagttattttaaaaccatgaattcaaacggatatatgtcttacgtaagtttttgcatacattggaggattgcctacatgacacatttttaatcaatactgtttctgtctgtccctgttttctatgaaacatggaacaaccaaattgagactataaatgtttctaactcataattaaccttttactaacaggtcaatgttatcgtgtagcaacctgaatataaccaacagagtttggataactctttcgccaatctgaattttggtagttctgacgagtccaaattgtatggcacaaccgccaatgtcatgaactccagcatggcacatggaggtagcttcagcttacatgggaacattgatggtatgggctcccactataaccaaggacttcagggccatttgagcggatcttctactcataggagcagcatgtcatcatattgggaacagccgctcatagaacaacataattcgcccgagatagagtcctcgagaggcatttcgtcaaacacgcatcctggaagctcttcaaataacacggtaataatggacagatcatcatatgctaaaagctcaggattcaataccactttcgactctgaaacagagccatcatcagacaacttcaaacttgaactacagttgaaagagacacagatagaatcgttagaaatagagataaaaaaattgaaggaggtattcaatcagggtttgactttcaagcagcaagaagagcagaaaatgaagaaatcaaaggctcttactttcgattctgaaatccagataccggcatccctggaaataatattttgtaagttatcagattcattaaagagaaaggaccaagaattacaagaaacaaaaagacgactagaaggaatagttacagcggttgcgcttaacccttcaaattctactacaaagtttggtagatatgacgaagaagctttagcacataaaatggtaactcgattggaaactttaatgaaggaaaacgaagaaatggcaaaaatgcttagttatggtcgagtgaaggagacaagtatcgagctcgaacttttacgtaaagaaaaccaagaactcaaagaaagactaaggattctacagcaagaaaagtaacaccaaagtataagatcttgatccttctttttctgatatttttgcttttttctgccaatgacattctagttggacgttttatttgacgatctaaaaactttcgagagtaattcaagatacatgtatgctatataacatctacctagattaggtatactttgctgacacacaaaaatgtaaatgaaccattgatatttatttcatccgacgttagaaacttacgattagagaaacttgaacatacaaagtgtagacctttatgtgaagtaattttagttgattaaataaactgtatgcggacttgtccttgtaatatgtacatgaggaggctcggaaaataaatattggttggccgtttattcttccagttacctgagtttggctatcttttcaagaagtgattgtgtgtttaagaagattatgaggtattacaaaaacgatgcgggaaaagtgattgttattcaagcctttgaaagagctcttctgtttttaacaccctttgccaataatcttagaacatcttcagttgtttcccaaccgatacaggcatcggtgatagaacatccgtaaatcaacttttcacggccaccttctggaggaacgtcttgtctaccttcgactaagttagattcgatcatgacaccacagatagcattttgaccagctgatagttgttcgtaaagtgactgagccacctttggttgatttctgaaatctttctttgaattcccatgagaacaatcaaccatgattcttctttggacaccttcagcatcagcaacctttgccttgaccaattcggcttgcgtcttttttacgttttcagcatcgaaattagttccagtcttaccacctcttaagataacaaaggtatcttcgttaccttctgttccaacgatggcagtgacaccaggtttagtaacagacaagaagtaatgtgagtgtgcagcagatctcatggcatcaacagcaacttggagaccaccgtcagtaccattcttaaaaccaattgggaaagaaagaccagaagctaattccctatgtagttgagattcagtggttctagcgccgatagcacccagagagaaacagtcactcaaaaattgtggagaaatggtgtccaacatttcaccagcgattggtaatttttcagtcaatctggtgaacatctctctagaaattcttaaacctttgttaatttggaaagaattatcgatatctggatcattgatcaaacctttccagccaacagtggttctaggtttctccaagtacgctctcataatgattaatagatcatcggataattcatcagaaattttcttcaaaaggtctgcgtattcgtaggcagcctttggatcatgaatagaacatggcccaataactacaactaaacggtcgtccttcccattcaaaatgtcacatactttctctctagcttcaacgatgatctttttggccttttcaccgatgggatattcatgttgtaataagtccggtggggtcaatggatcatatcccttgattctccagtcttctaaactacttctgtccccaatatgatcgttagtgatgaacattttttactaccctgtttttaccgcaatggtggtatcagtgaatgtcttcttgcctctattgctcttcctttggcaaatggaaaagagtggatggctcatcgaaaagtgttgtgatgatgttccatccaattttttttttcactttttgtgcaaagaaatcatgcctatatacatttctggaaaaatattatgagtaacaatttgaaaagaaaaaaaaaaatttccagtaacgacacagagttttgccgaaccagaaacaaggtacgaatatttatcatagtcgcagggtgaagtaccgttgcttatactttaggtgcaacaattgaaaaattttgaagtttcagtaaaaagtacaggttaaatttgtgcaatgtaatgtgtatttggttcaaagttggagttagttatactgaatacgtcggaaaaactgcatggcaacgggtactgccccaggaataataagttttgtgtcacgtggtatgcgagaattcaccatttatatcatttcaaggttttgtattggccatagtgtctgttatagaccggggtcatttcaaaagcacatttcctgccattgaccatttttatcattcacgaatcaaattcatatatatgtatggatataggtttgtatgcacagattagtttctagaacgtggctatttcttcccaacatatcgaacagtaataatcgaagttcattgcgggatgggcaaaagaagaatagtcaatggtatatcactcaattgcccatgttgttcattcatgtcaacagtttgcctttggatcgactaaggaccgttaaatacagaaatatattaaattgttcggtgatgatatagaatgatatagattacatataatacaggtcgctctaaatactgcttcaattatactattaacgatagattgaacagcagtgtactgtgcggtgatacatttattttcatttttgtttgtagttttgtgttattcagtttggatccatctttcaagagaatgttcaagcattgatctaaggcccgcttaatatagaacagcataactcgaacaagcaacaacacattaatgctttacaacacgtcccgcaacacccactgtcctgtcttggaggagcttgctgaacgtataccggctgctgaggctgttggtagtacattggctgttgttgttgctgatacactggttgttgatagtacattggctgtcgatgacggcccattgttggaattgtattgttttatgtgatttcctagatctgcttgcctctttggtttgctattgaatggattaggactccaaccgaacctcttctcgacactaagtcgtctcgtcaatactacttatatatatatatatatatatatataacatgtaggttacggctgtaataatgtttcaagttctaatcataggtattttcgatagcttttttcgaatgtttcttttctcctcattcgaaagttctttctaagccttgcgcgtctgtgcacaaatcctgcagaaagactgaacaagtgcacatcggcaacttagcagtaaaggctgaaagatgagttcagaagcgggattcatggtttattaaagttaggcttagttgtacaaacagtgtaagtatgaaatatgacaggaaaaaggaaaaaaaaccacttgttgggtcatattagggtcatattagggttaagatacattcggaccctctggtaataaaatgctgttaaaaataacttactgcgctatcagctgacaatcagctattttttttgaagtaaagtattttacggtaagtttgagggaagttataccccagaagataaatcaatgtcattgacatttgccatatctagttatattctgtccaaagttatacatcagatgaatcgaaagatccaaaaaaaaaacatccatgtgtagtacgcctaataatgattgaagttggctatagcttgatcaaacccttgttcccattcccacatatattctccatcacccttactttttatatactgtactcttctgaaatatttccaagcacaggttcttcctaagagtgaattgttaaatgtcgtgaacgattcgatgtccttgattgtattgcgaagagcgtcctcaaatctccagtgttccatcttgtcaccacctttgtcagcccagtagtttttgtggtcttcaacaagtttattgattgcaccattgtcgggtttcttccacgtcgtgggtctgtttggaatagcgcctttattgaccataggaatatatccccattctcctccatctccagattcaaattgaagagtccagaagaaccatccccaggatgcctgcctctggaatatacttgtctgtgcttgtccatatttcttcacaagatcatctctgtttccggaagtcttgtcccagctttgaccatcaatgacacaggaaaactcagctactgtgaaatctgccttagacctgtcaaattgcactgaggatgataaatcttgaatcaatttttcaacgttcttggccttgtccgaatcgctgaagcatcgatacacatgtgagtcgattataacgtcggtgaatagttttttttcctgaacccagtcagaccactgttgaggccaccagccatctgaaataaccaccggtaaggtactgttgatagaacgcactttttcgacagccttttcataataagatttttgtttcttaccgctttcatcaaattgagcttcattgacaatttgcaatccgattaaatttacatttgattgtagatcttgcaccacaaaaggtataacattatcaacgattgatttgacgaaactcgattcatcaaagaaagtagcagaaccacagctttgttcgccactatgggcatctccattagctccgcctggtaatccatgtaaatccaatagaactccaattttattctcatttgccaaagaaatcacctttttcactctgtcccatggtttcgacttggaataaacgtccttcaagctatagaacttctcgccatttttcaataattcaccatttttgacatgccaatatccaacaggcaacctaatcgcagtacacccaactgatcttaaccaattccaatctacacgattcaaatatgaatcataatgatcagataattttttggcagtgtcatttgagttgcttgctttgacctggtttgtgatagcatcaaattcattaccaccaccagcagaaaatagactatggaagatatattgctctagtacgaacattgatccgaaattaacaccataattagttctgttctgatagaaaattcgttcgtctttcaattcacctggttgaggtaagtccaagaacgttacttctcttgatttattcaaaaccttctgttttagcttatcgaacatgattggctctttaatatttgaatactaaattatgcttcaagacaagcatccgatatgtgatcccttcacaaaaacaaatatctcttgaaccgaagtatccgttacattcaatggtctttataggtttaacttaacttaacttcaacttcctctacttttccaacacgcctcatccaaaggtgtataaaattcatcagtagcaaaggtttggctcttttaaaagaaatatgtcataaaatgcaaggtactatccaaataaaagccctttttttaaagaaatgaaatatctgtaggtgtttctatgtaaaaaggattcgtaaaaaaggtctgtcagtttggaaaatacaatactcagcgaagcatttttggaatacgtgcatacccccacaggagattaggtagtgggacagagctatttaaattaatcgacaaatatctaataggagggaatttattttgaattgcagccctttaatttaacacgatgaaacctagattaatattgctgatcagacatggtgaaagtgaatctaataaagataagaaagtgaatgaacacactccaaaccatttgatcccgttaacgaagaatgggagatatcaggccagaatggccggtatagaaattttgaaactgttgaatgtcgacgacgattcgatcaccaaggatattgaggctgaagaggattacgttgaagatagaccacaactggagcaaaactatcaaagggtgaaatccactaaggatacggatctagtattttacacctctccataccgtagaaccagagaaacattgaaagggatcattgagatgattgatagatacaacgaattgaattgcggcataagagtatgcgagggggaaacgtatcaacctttgggaacaagaagattggcacactggcaatgccccgtgtttccaagtgcagtgttcgaaaataatgaaagcgtaacgaattttaaactaattaacaatactgagaccaatccgagtcttatacatgaggagaaacatttccttcactaccgtgtgaaggaagagcctcggattagggaacaagattttggtaatttccagaagactgcatcgatgaccgaggtgatgaatacaagagctaattacggtcattttttcttcaggttccctcaaggtgaatctgctgcagacgtttacgaccggtgttcagggtttcaggaatcgttatttcgccatttcgagaaaagtggagggaaaaaaagggacgtggtagctattgttacacatggtatattcttacgcgtgttcttaatgaaatggtttagatggacatacgaagagtttgaatcattaactaacgttccgaacggtagtgtcatcgtgatggaattggatgaaaaggatgacagatacgtattgcggacaacattgcccaaatggtgctgagggaacgaaaaagtaaacattatttgtagcattcatatccaaacgtaatgaattaataaaataaactgattttaaccactgaggtaatatttatctggataattgtgagtgcttgaattaccttctatctcacgtgatttgattctattggacaaaaagggaaagaccctcctgagagattaaaataattacccggatctaagagatttcacgttaaaatatacatctccttccgagtactcttagcttccactattttaacggggctattcatgcgttccgggtaatgaggtgttcccggagccaaaaatcatcttcctttatttcgcatcctataatgacgaaatgcaaaaacaccatgcgggcacgaagttgggcttcttctttttccggctcacagaataggacgctgccgattgtcaaagtcaatcagtgtgctgtctgacaacctgatagttggttccatggttttcagtaacatacgcatacctcctgctcactttgactataggaaacagaccatggtgatttccattcgataatgtttctaaacacttgaactttcatgtattctttcgaaccttcttcgtatttttgttttatgtatatatatatatatatatgtgtataaatttcatagaaaggtttaaagatcaattgatactcgtaaccacttctttatcagtcgaattattggtttattggttttgtttcaaggaaaaccaaggaacagcatcatcaattgattatcattcccctatttcaactaacacacacataactcacatacaatcatggctagaacattcttcattggtggtaacttcaagatgaacggaagcaaggcttccatcaaggaaatcgttgacagattgaatggagcttccatcccatctaacgtcgaagtggttatcgctccaccagctatctacttggaccacgctgttgcattaaacaagagaaaggaagttaaaatctctgctcaaaatgcatactccaaggcttccggtgcttacactggtgaaaactccgttgaacaaatcaaggatgtcggtgctgaatgggttatcttgggtcactctgaaagaagaacttacttcaacgaaactgatgaaatcgtcgccgaaaaaaccaaatttgctttggacagcggtgtcaaggttatcctatgtatcggtgaaactttggaagaaaagcaacaaaacatcactctacaagtcgtccaaagacaattgcaagccgtattggaaaaggttcaagactggactaacgtagtcgttgcctacgaaccagtctgggctattggtaccggtttggctgctactgctgaagatgctcaagatatccaccactccatcagagaattcttggctgaaaagctatccagagatgtcgctgactctgttagaatcttgtacggtggttctgctaacggtaagaacgctgttaccttcaaggacaaggctgatgtcgatggtttcttggtcggtggtgcttctttgaagccagaattcgttgacatcatcaactccagagtttaaattcactctgagaattctccccttcttatataatgaatacgatagttacctaggattttaaatttctatgtaccaataaacgataataacctctatcaagctggtaatagccgtgttgaattttttctaaacaagcactccgtagtatttggcttttgggtatattggcaataagtcggcccattgtactacaaactcatccgctagtggatacaatatcattccagtcaaactcaagcggttagtacgagccaaggactctacatatacgattttagacggttgccacaaaaatatatggtataatttgagccaaaatgtaataatgcagcatgtcccgggcccattgagtaaagttaaattgggatggcctcgcatggaggactttatacgatatgtgagtaccatagatctgattgcagttttaatgatagattttattgaacctgctagtgaactacccacatcacgtgctttatcaaagcggtgatatattacctttgctcgtaatgtatttgaaacagagatctgatgtatcttgttcttgaactttattatgctatcatcatccgaataaccaacatgaatcgtaactgcactttcaagaagcataccttgatagtgttcaattaatcttaacatctcaccggtatggcctccagaacccaagaaaataaatagaaccaaattcttcattctaccccctacattatccttgtctttggtcagaggacccgcttctctactactgtggaaaataggaatcaccaagcagattcgtacaagaagcaacgtcacactccatatcaacaaacaccatgcagtagtcagcagcattatacactaagtgatataattgtagggcttcaaaatgcaccgtaacaattcgacagcggtaacacccgacagacgcacaggaaaaacacctaagtaaagcaaagggatagaggttgatgtcagaataatacgcctagtagactttatcgggtcataactatttcgtttgagaaacggtcataaaccattttattttgaacctgcaagtaaattcattcatgaagtgctggtaaatgataatggatctagcattaatcaaggtcacgtgaaataaattccccgatatggtaattttatgttggtttcctctgcttttacagtcttaccatgcggaaaaaagtataatctcctaattgggaaatagctggtctccagagagatgtagacagaaaggtactgtatacgcaacaggttaaagcaacgttttagagacaatgatcgtacctgagagaaaactggttgtttcctcgagttacaagcatattaccacagcgcaaataaccagcccacattttttctttgtacatcgatatcactggctggttctttttcaggtgacaagacgcgaaagccaacttttaaactttttcactacgcgctcatagtgaatgtcagttggaacgttcagcatgaaatctctgatttacgtacatctatagaaaaaaaaatgcagcaggatcaagttttggtgagctccttcatatatatatcaacttatcattatcattcgaactgaccccaacgcacccttctcatcgtacattggttttgatctctttctggataaacagtgaaagttgtatcttttgactactattgaacggagtgttacaaatcatatactatcatcatgagcaaaccaagaagtcagttgaagcgcagcactgttatcctagacgacaatatggtacgcgaatacaaactcgctgttgagaaacttgcgccagtggatcagagaaataatactaataccagatcagaatctagtaagtccatcacctccatgatgacgatggactccgtattgtcacgtgataactccatcatggacttacttctggagcaacagacgttagaggatgagaatgagaatgatatggaagtggtttttctgacaaaggatgatacgaatgccgatttagactggaacatttgggaagcagaaagctatgttctcaccagaacctcactagagtttcaaacgaaatagattccgtttgaacgttctcaatgcatttttccagttttcctttcacactgatttgtgaaatatgagttaaaaaactcaaaatcacgcataagcaagactttactgtgtagaccacagcgattctttgtacattactgctactagccagactcggtcagtgtccctaaatattaactaataatcataataatcattataatggcaccattaccgtggataatacggcggtaaattctttgaattacataacagctagtgagagaatttaacgcatacggttttacctactgattgtaatgccttgttcaaaaaaattaccgaacagcccatcttatccgctgcgttaatattagccaaagaacgcaaccctgattattcatccatggtacaaacttgtattcttgcgatgaggcgtgtcttcacctgtagatagtgtttgtcttcggtaatagaaatttctggactcacgtagaattttctattacccggcccctggataatatgtcggaacactaatgtcagaataaggttgtaattgatgagctagtggatgaggaatatagcgacactaggttttaagggatacttttggaagttaatggagccaatttctcaggtgatatggggttatagggggtggaatcgtggcattaagaactttcttccactttctttggcagcttatagaagtttttgctaatgtcggtatattcttactggggtcctaatcggactacctgtgaagagtataaatggagagcatctagagtaattcaacaggtcaattgcaaactgttcttgctggtattttagtgctttctctccataaacactcacacaactaccaaagaacaattatttggttttcattatactaggtttttacaactactgcgctaaagctttaaaacaaatcattacaatacttcagattaaaaatgtcttttaactcaccatttttggaattcttcgacgctatcaaccaagaggttgaccaatttaacagattgttgaattcgagtggagttgttgctccaaagaaaattgaaggtaattatcctgctgattcgagacaggtcgcaaaacagtccaagaacaatagtaactcattatcaaactggttcaaagacccatggtttgctgacctaggtcaaaatttgattcctcctttggacatcttggatcatgaaaaggaatacgaagttcatgttagcgtcccaggcatcaaggaaaagaaagatattaacttagagtaccacaaggatgccaatgaaatcgtcatatcaggtgagatcccagacgtgacaactgaggagaccaaagattctgcaaagataagagaaagaagatatggtaaatttagcagagttgtcagattaccagattccccaggtatcgacgttgaaaacatcaaggcaaactacactaacggtgtcttagtcttgaatgttccaaaattgaaacctactgaagaggataaggctaaggtctataagattgaagttggcgatgaagctgctaaattgtaagttcgttccgatgagatttttgacttatgatgaatgataacaaatattatgataacagctttactgaaataaatacatctaatgattcaagaaatgcgaatatgttgaacgtatttcattttacttaatctatgtgttattccactgattaattcacatttataagttattgttgtgttctaagcagtggtggaagttatcgtatcggctttcttggtttttctttggttttaggtataaactcaattcaattcatatatacatataactactgttctaacaaccctttttatatgctttcacctaccctattttactcaagaatatggttactagagcggtatttctgctctgagagcccttgtctttcagaaatatttatttatatgatgctaatgaaatagattatgctattgattgatgtcgaatatcttttaatcgtatgctatcttagtgttgcaatatataaacatgctaagcatagtaaatgtatacagtacatatttactgagctccaattgatgatggcattagatgacttcgaagaaaacagtgaatgttaatcagttttcgttacctaatcaactttcacgcaagagtagatttttctgacaagaattaaactactcaaaaatccgattgcacctgtcactaaacaacatagaccactaattagtatggagtaacccaagtataaaacaatcgttgttaaacctcctaatctaaacttggtgaaaagtatagagtgacagaaaacataaaatgcacaaccgcatcctccgataacgaaacttctccattgccatttccaattttccatacatagcgagtgatatgtcaaaagaacggtgatcaatgatgttgttaaggcgagcaatatgaaggaaaagaataaaaatccaaacatgtaataaattttgttgaaccatagagaagagtagatgaaatataactcaacggcaattgaaccgaatgggaatattcctgcgagtaatgccactggaatagtctttaagtaccatggttggaatggaatttgtcttgctatttggttggtctttgttggatgttcattccaattacattttttccatgcaatgacggatccgatagccgataaaggaatcgagataacgaaccatagtagaactaatacaagcatggtctggaatggaatagcgcctgaggagtgtacaaagattaaaaaaaagttcaatccgaggaccacagtcaaaatagatcctggtaccaaaagtggggtgagcacgaggttcaacctccatgcttttccattgaagaacttgtaagtggccatagatgtaaaggaaccgaaagatccaaaaatggcatatagcaaaaacatgacggtagacaaagaaccgcgagaacttggggacaagaatccgagacacgcaaataagatggttgtcgttaacattagtgctagttgaccaccagagccaactagaacagatagaagtagtgctttgtttggggaacggaacacatcaccgtgaatcaacttccaaccagtttcttcttcgaaatcggtgtccaagtttagctcgttgtaacgagctaaatcattcttcaaagcactatacaatgagtgcaacataacagaagacaacaaaacaacaatagtagagaagtttatcaatgagaaccattgaatctttggatcgtagacgtgtaggtatttatcccatctagtagcccatactgtgtcactcttgatgaatttaactgagtatgtgaaataaacttcattatcctcggtttcgcttagtaccaaagatttacccgtactttcacaactatcagggctatcacgttttatagaagcaggattaacggtaacaccgacaatacggtagttgttctcacctctgtcatggtattcaatttgaatgtcgtagtgattaacaaaatatggaatttccgtaactttatcccctggagataacacgtttttcttcgcgtttagctgcaactctaattcatcatgcaaagacctagtgtcaggctcgtaatccgataatacatcaacaagacccaactcaaatccgttaccgtaaaagatcttgtttgttttggtgtcctccatttttcttgcagcaggtaaaccatcaatgatccagttctggaaaaatccattcaagatcaatttgttaatgaattttgcatctttgcctgggatcactgacttacacaacgattgacattccacatttttcaacaattgtaacttgaacggagaattatagattcgatcaccgaaaataatcgatcccaaggactctggctgctttttcaattctgctggttgacagaaatggaacttcttgtagtaatagtcataagagtacaaaaatccttctttatcaccagtgtcatgttgatctgtgtcgtaatgtttataaaattgagatggagtcaaatgattgaccaataacggtaaatcatcgccttcatggtatgtagttggtgccacgccaggtaaatagaacgcttcgactaaaagcgatcctatgagcgtagaaaccaacaagcttcgccacaagtaagtaaacattgtgcagaagaactgttatttataattgtctctcttttcacttctattaaacaaaaagagatatcccacgcagttgataagccaaaagtccagttaaacaaaaattgtgaaccacaatggaatgactagactccaggtaggaaacaacaacccagatcaactaatcaatggttcaagataatccttgcaacctttactcttttaaatgtcaaaaattaacattaacaaaagtagtattccaatttttcaatttaaaaatgaaaacaattttttcgagttctagaatgcgccaataaaatgaaagtcgaaaatacaaactcgcgcagaatatatacgcaatggcgaaacaattgggaatcgtcaagccgttgaagttgtgtctggggtcctataccaattgagtgaccaagagagcgttatttttcatgtgtaatttttcctctttattttaaactatttgaatacgtaaagaatgaagttaagttgatcacgtgtaacatgattacccggagatgtgcctggtgtcttccgttattcaagttaacgcattaatgatagaaccgccacatatttcaagataatgaccccagtatgcgtgtatcatacttgccccaacggaaacactttaggcaccttgacacgaaaactagtgtcaacttttgcggtaactctctgcttttgcttctgtgctgaatctcttaaagaaggtcaattgttaaccctgccatttaaaaaatcaaaaagaacttgaatatagtgtgtttatgttatagaattcgatgagataaacaattcctatgtggtgaaaattgagttatagctcttcttttagtgtttaaacgacattcgaaacaaaatttacgagtctgctagccatagcatcccatcatgtcgttacaattctcatatgagaaatatatgaacctgatacagtatccggaacactggtcaaatccgataccgcacgaaatatcaaagaaggtgatatacaatacactttcaccatgcatatgtgttcaaagcaatctagagctggataatcatttaaaagatatgtataacattgattcgatatcgatgctatttagatactttggtgactatatccaagacagagatcaaattccatcaactaccgatttgaaggaccctggatccgtttcaagtggacggcacagatcagattctttgtttcagagacaggcttcggagtgtgtacgattcaccagatcacttgaagatcttatatccattgattctgaggatcatattcttcaatcaacagacattgatagttttctatcacaatatttgcaaaatttagaaccaattatgaatgaaaatggcacacccagcaaacttttaaaacactcgatatatcacagattttttatcactttatcctcgataaacctttcgcgatatcatagtttccatcatcctgttgtagccttattgccattggatattaccaaaggtcaaggttatgaaaatgcaagagaaatactaatacactttaaaaacttgaataataccctagaaaatttcccggagttcatcaatattaacgacatactaccagtttttgtgttatgttatgatgaaaactcaagagagcaatgggaatcagtgcaggctttgaccaaaagtttaaagaaacaattatttgtcgaaagtgtttccatttccctattcacacctcacgataaccaaaaatcaaccaccttacattcaccaattacggtctccttacatgagcaggtttttaacatgtctcatccaacatccattaacataccttcgcggttactgacacatatttacgacacaatatcattcatagtggaggaaatgatgattcctttcatgcatcggaaattggtgttctgggatgaaaccgttttgcagcctagaaaatccatatttcagagcaataaattcttccgcaggtttatttctccgaaatcgaaccatccaatagcgcataaagttaatgaccctcaggatccagctgaaggtgatattatgttccctgcttcatctccagaatttctgttacggaagctcgcagattggtcattcatgctatctgacttcaaaaaagcatattccatctatgatttgctcacaaaagactttgaatcgtatccccaatatttggcaccttgcctcgaatataaaacaatttcgttattaatgggtgctcaaaatataattacggcaaagactatcaagaccgaagtggaccctttgatgaccagagccatagaacaatacaaaaaacaggacgaaaagcactcgcttcgggtaattcattgcatcctaacgttttcagatttgttattatcattaagtgatacctgggtttcctccccgctagctgttaattatttgacgtatattcaaaaatcacatctcttaggtccatatgcaaccgtaataatattggaacggatagcctatgcttatgaaatttgcatcgatttaagagttaatgatcatttccttcctaaaccagatgaagaaaacaaagcggatgaatctgaagctgctgagaattctaaaaagggagaaaatggacttgaagtggatgatatgcatgaatggagaaatgagaacaagctgatccaaaacaacctaaggtcagaggggctaactcggtttagaaagtactctttgtatcaattggttgctgctaaaaaatgggtagaactacataaaaggaatcaagctaagtggtgcatttatcatgctgctcctgcatacgaaaaactaagtctttctaaaaggcccgatggccttttccatagactgtctatggagttgtcataattacacgctagagattattatctataagtccttgtattaatactaaataaattgtttatgatcagatacgtcatgaattaaatgaatttcattagcttctcaggaggaacggtatctaacatctcgtcttggttgattcttggtttgagggattcatagccgttattattgataaagaagtagcaaattagcgcaccaattaggccaattacagcaacggtagctaatgctaaagccaaacctatcaacacgatgaatcctctgtctatttttttatcttttgtggaatgcgatgagctggttgtagatggtgttggggtggatgaagcagatgtgtcagaattgttgctctgtagcacggtttgtgaagaagaaagatatagatcgttaacattttggaaaaatgaactacttggtaggctctcctgctcttttgggtcagaaattacgaaatatggttgccatttttgtgttgaaccatcataaactacagaggtcagattgccccattctgatgagttcaaagttccttccaagaggacgatatgagacccttcatctctctttttagattcagtaccagatagcactttaaaaccagaaacaatagagtcattgttcaattggggcccaaatgaactccaggtcccactttctaatcggagtatttcactattcatttgagcaatgatattgtcggtagaatcatcgataggaacaaatgacagtagaggttccgtaccagattttaccgtcgaaaatatgttgctacccacttccacagaaagaagttgtatattagactcgttgttagtcttaattaaaccaccaactagaagggttttcccttcgtccgcaaactgcatttgtcttatatcgccagtgattgaatcatttaagaagctagtccattctttagtttggtagttatatagacacaagtcattgcaattgtctatctcgtatgatccaccgactagaatactattattagaactaaaagaaaccatagaatttacacgttcattggttgaaaagttaactcgagcaacgttttcgtaaccggtcaagttcagtatgctaaattgaacatcatattggcttgaagaattgcttccattggtaccaatagccaaaatattcggtacattatcatataaaaaggcgttaattggagcagaccattgaatctgtagcatatgcgaggaggaatttgtgttggtaattaataccctatgttgaacattgtcagttgagccttcttgtaaggcataagcagctgaagtatcattaatatacgccgccttgtaaggttgaacatctgttggtagctcaggtaaagtaggtgatgatacttgtccatcagatgacagggatgccagtccattgagttcaccgacagaccttttcaaaaaggagccaaataataaagagtcgttaccagaattaatcccagccgactgtccagttatttcaaacgtggaggagttggaaacatacatatttgcagacacgttgaaaatataggcgttgtcgaagagcaaaagctcatgcccatcaatggtaaagttcacgatcctgtcgatgggctcatctaattggccaaagctattgaaggcattaccatcatagctcaaaatttcatgccgactgtcattctctacttggtaggtacccgataataataaaccatttgagtactcaaagataccagtagtatatccagacgttcctagtttttgagaggaagaaatcaatgcttcatcgttgagttccactttagcaatcccattgaaattgcctccgatcaaaatatcgttattcaaggaggcagcataaagattggcatcgagcgggaaattataaagagcataatcattaaatgtatcattcgtgctgaaaattgatgctgtcacatttgcagtgttgtattggaacaaaccgttgagatgaaaggttgtatcattgctgctgatacttatggtgtcaatatactcagtaataacacccaagcggtcaaccaccatgactgaatcgctttcaccaatcgctttatcccaggttacaattatttccggtgcgcttcctaatgaacctgtatacagagggtcgaatttatcctcattgttggtctgataaatcaatacactggccagcacttcatttatagaacgatcaatcatagtgacatttacgatacctcttttagagcaagaattgtcttgtagacagcctggtgtgtagatattgaaagtgtatcttcctggataagtaatgttggggtggaaggtgacataagggatattatcgtcgatgttagttgatatataggtatcagattcgtcagtggtgtaccagttatcagaggatagctctgcctttgaatattccgtaactgattcgcagtttggttcattataactattattggcgtacaccataaattccgtttcgaatatctcaatagaatgcaacgcggcattacttccataggacgctagagctacaaactgtaacatggtaacaggtatgtcattaacaaaagcaaactcctgataggattctgaccatttcaaattggtactattgttattgatgcccactgactttggagctgcagtggagttttggcttatctgtgtcaaatcttctatcgatagtaatggacaccatgcatcgcactgtttcagctctcctgatgcaggatccaaatacgtcaaattcatgataccattggaaggaccggtaataattctgaacagggaaatttcagaattttcttccacagaattatatattcttaccttggatgggtggatctcatttttcaaatcgaattgcaaagtggattgaacggcttcagatgcagaccaaccattttgcccaccagagggacacagaagaatatctgattgaacattttctccggtgatagatgaaagtttcaaaggtactgattgatcgaattgtagggacgtcaaatcttcatgagatgaattggtcgcattgccaaactcttgtaaaagcgatgcgttttgaatctcttggaaactaccagcgaacaatatattatcggagtttaatttcacgactgaattaacgattgaattttcaccaaatcctttgaaaggaaataattcagtggtgtttgcgacaacatcccataatacagccccatgtcctgtctcgttggagactgacatagaaaagttaccaacaaatatgacagtttcattgacggtcagaatgtccattacattctcgactgcactagggaatattggtgatgtggtcaagctggttaaatttaataatatttgctgttccaaagcaactccattaatttgacctgttcccgacaaaatgaatgaatcctcaaacaaaggaacaatcatggttacagtggtctctggcgatgtttcaaacaatttaacaaatgtatcattgctatagtataataatgacgactcattggcttgaacagtgaaattttgttggcctgtataggatatcactgtcagttcctcaaaattattcatgtacgtcaaatcaggggaatcccaattgggtgcctcataacgtgagatattcaacaacttttcaatgtttgacagctgactgcctcttaccattccagccaggacgagcaacacatatatcaggggatttattgagaacattgtttggatcagtgaagactttgatgtatttcaaaaatagaaggaatgacggaagttggttttaatgagagattagatcaagttgtgcaaaatcaaacagcaaagaacaatgttaatggtaagacagaatgaatgacgttattaggagagtcaagtaccaaaaaactaaatcaatgaagagaatcctccaaggaacacttaactgatatcttacaggcaggaattaaagcaatatgataaaaacaattgatacactatttgttaccatgcactaaccagatttaagggaagaggaaaagctgcacgaataaaggccttttttgattgcttctctcgtatctgttaaatgagatcaattaaagcctaattggaaaattcgaaatcagtatattagaccaaatatttgttgtgactcttttaaacagtgaacagtaattgaccagcacactaacttgttcgactaaccagtagagttatcaaaaaaggattaagatcaatcgaaaatcaaggacgctacaggtctgcttctaaagatatcaaaatgatggagtgctaagattttacatataattattacttttcaactaaacctaccaaaaattaaaaaaaaacaaaatggtaatgaatcaatacaaattggcattgtctttttcatggaccaaaaggttaattcttttgaataactactcccgcacgaaaaaaaattcatatagatgagaactagccaaaaacaaataaggtattatttcttcaatggtacaacttcacaactttgattgtgtgtttgtctcagaaaattatttgtaaatgacattgtttacttagcctaatcctgggtctcgtcctaaattccccatttgtttgcctttttcgttgttgaaacgaaaggcttctattcaaataaaaactgaaatcactttccacggatgtaaacaagataagaaagaaacgactccactgtcaaaaacaacattatttcctcattaggcaaaagcaaatcaacaagggtaggtcatgtgggatgcttgtagggtaatgctttgggtgcaagaccctccagcacctcgggaattcatagaagtagcttttacgtacgcattttccttttcagcttgtcagtaagaagttatataaagagtaatagctttggtaaacctttcaactcataaatgcaagtaggttcacacaggacaagccatagtcatgtacataaattgagttaatctgggaattaaaatcatcatctcgattctcaatttttggattacctctctttagagctaattaatcccctttttactgtttgtggagacaaaaagtagatttgttaagtaggaatttcatgtgcgctcgcttcttctgatcctaaattgagttgtaactctatttaggcttttattacatcatatatagtgcatattttggtttgttttttccggccgttgcgctggtcgacgtcagaaaaatacgaaggaaccttaggctgtggccgttccagcatacaggagaatggcatatacggagcatcctactgtctactatttgctgcacattttgcgtactgggcattttaaggttacagaaaggtcgttcggtgctggctaatggatattagaacattaacgtgatcatcaagcctttttagattatagtgccgtcaacgattttgtctgttgcatttcacgctcttagtatttcatataagacaagctaacacagcgccttttaaattgacttatttgttttgcgagatgtgtcgaccaatgcgatttgccgtgataatcgacgcagcaatcggataaactccaaactatatccaaaataccatttaaatggttactattgcgttattccaaaaaaaataactgtgcctttctacccacatcaagctgcaggtacatttggtaatgtctacatatgaatcacttaccaattcattgaaaattattcgcatactacagaaatttggatagaaagcatgactttcttattaggcttttattttcgctgttggatgggcccacctaacggggaggtgaattgagtgaaggtcgaaaaaattgtctcgatgttcgaactttagttaagagcttcctattcggaatactgtgctcttcttatttctctgaataatcccagttggttttaccatcctgcaggcattgtatgtttaatattccatcatggaatgtagagtgtttgctgcttatcattacgtcatcgtcaatgcacatttgtgattaatactgtatgtagtcttcaacggagctgttgaggttctgtgataatggggacccattcgtactttgtattgccctacaacatgaagatgggatatacctcaaagacatcagtcaattcattctcttgggggggtgttgtctcaggcagaacgagagtacactattcaggatccaacagttgatacttatctcgcacaatctttggccgctgaattcaagagagaaattgaatgttctttgatagtattttcaaaatgatagtgggaatgttacacataaagaagagagcgttcgttagattgaagtgaaaaatttctcaaggtatttcatttcatttacagtatgtgtttctacacaaataaaatgaatgccatggtatttgattcgcatcacagttactcagaagcgatctggtaatgcagtttacttgaaattagtaaacccttgtatatttttttttcccactccatactcttgctttgctactagttacgcaaatgaaaccgcttcaagagaacatgtaaaggtggaaacttgatgcattacttgttatcgtactctatcgtttgctgtctgtacgacctttccctttcatttgaaaaatcagcccctaattacgctttcaatttcaagccgttatgggagggaatcttgaagaactcgtaagatgacaccgagaagcgtgagaaaaatgatagagatatagatgaaaaagcatctgtttcctgtcaacatctttcgcatctcgacctcaaacattaaaaacaaaagttagttgttactattaatattagattagtgatacaaatttgttaatgcgaggtttcgaacttccatgttcattcgatttaattgcagagcttaagaatggcaatccctactttcctactggtttgtttgttgacggttaattgtttggttagcaggtttcggttaaattccaattacattttggattgaagatttagatgtctagctaaatcatcatcatttgatcggcttttctctaaccaacaattctctctttcaacttttgaattacgtagaaataggtaatatttttccgttagaactagattaaaatttcaagcaatttaactgttctttgttaaaaagtatgttatattttggacataactccatggggaattactcaattgaatagagaatgcgcttcaaacaaacacgatcaagctgtttatgtgttgttctttcatttatcacagaaagtcaaaatggttctgcatcctatttgtttgaataatttcaacaggagtaaacaaagaagaaggaagtgaagcaacatcagattaacagtggttaacagtaaacattgaaatgacaaataatgatacaaggaagtattagcaggcgttcagatagttggtatgataatgagcacccaataaacgctgcaatcaatggttaaggaaaacatttcataaggcactgtttggatatactttaagaaaagtgttgaaatctctacctcatcaaacagtcttccgacacttacaaaactaccatgaagagagacagaccactagtagaatcttatagaactgttgttggaaagtcaagcgttcttcatatcatagctggccggaaactaactgcgttccttgaatgaacatcatttttaagttaaaagttaaatgtagcgctctaatgaaagaacagaaacataattaacgaggtagagagaattttttgaggtcaattaaagttcatttttttaacggcattcttgcttttgattgcatttctatttttgttgtttattccttattaaaggttaaccaataaactatgaaccagtatcaagttgcaattgttgcagttatggagtattattatcattattacaattgcaagtattaagcggttgtattgaaccgacatgtagttatcttgccagatctggtcgttgtttgagcaggtccatcttcagctgattcaaattattacacacccaaataacagaatgatcattttgagctcttatgccatctatgatatccaaaatttcctcagaagtaaaactggtagaattcacaattgtttcaacgaatgagcaaaaagctttgcgtttttggaaagtccttttcttttggaactttgccaatttcgatctcccatggtcttgaacaaacgagtcaatttgaggtttcaatgattgcatgaattcgttatatatcgaatacactgagtccaggtcgttcttcattacgatactcaagctaccatcatcagtcacgagataattcttgccatcttcacttaaaggtggtttgaactgttgaccctttgacaccgaagcaacaccaatttttttagcatgcattgttttagcttgtttgtttatgttaagttgctgagggtgatcagtatccgtattcatacgacgagggagattctcagtattctcttcatacgctatgttaaatgcaatatccagtccagatgaatttttgctgtaagcactagtggtggcatggtcgaatttagaagaattcgtagcgttagatggaaccgactgtgagagttggctttttggataagtaacatgattgaatgtaaagggataagtgatcatattatccatcaattgctccatggaggtggatagaccagaagatggtatattttttgccgaattaagaggagagatagaagtagaaatggcctgatcttgagtatttgagtttgagaggtattctttcgttggtttggcatctagctttgtatcgctttttttcaacaggtgtgggttttcaaagagatactgcaagttttgttttaggtaattaacgtattcccttaactgctggttctctgcaattagattttgtacattataatgaagagataaattttctgatgccatgaaatactgagatggaggaatatagtgaacacttgtgttaccttgaaaatgttcttggtttaataaattatcttgttgagtgtgtcgctgacgttgttgaattcttaacgtatcacttgagtcgataggtgatgtaggatccgcctttgacgattggaactttgtgacttcgagttcttttttaataggctggggcaattgactaaactgttctgttctcattgaaaatatacgttctctgatagcgttgacatcgatcgcatctcactgaaaaaaagaaactgaatcatttccgacaatatctatagattgaaatacctgctgttgcacttcagataatgctctaatggcttcaatcagtaacgtgattgttgacgagccgtgatgacagattctgatatcatcttgaatgaatctgaaacatttatcattggttactaaagcattagcaaacagtgggtcctgagatcgaacactgcaccacttaaagtatcgaagtacgcatggaagagcagttgtttttagaattgacaatggaaacatattagctattggaagcattttggccaatcttataggtatattgctgaccgtttcgtacatgctaatgcaatttcctactatccctgtaaagtcatcaatgctcctgcccttttccaaggagaggaacatgtcgttgagcatgaagtacatgttcatggagataccatctacttctgctgtatttagagtaatcctcttcggtatccttgtaaggttccctgatgacaattcttcggtagcgctggggccaaggttgtcactttccttggtactgtcacttgtggtatcgtcatcattattcaattgtgagtcggtgctatcgtcacttgatagatgttctggtccttcttgaccaggtatgatggtatgactagcagttgaagagctaaggtcactatttgtagacctatttgcattcataaaattaattccgttatatgaagttaagtgagtttccctgcacaaaacaacttaattcgtattaaattgataattttgcctgggtttgattcaaaaagaagttaacaatgacgacaaaaataaagcagagataaattgcaaagaattgggaaatattggaatattggattacacggtgtcaggtattttcccttactatccgatgttcacagttatcaactgaatcaaaaaaaacccaagatctgaaattcttcctaagcgactcaagattatattgcaccacacctttctaagaaaacctgtatcgaaaagtgactggcgaataacgtgagatataaatgaaggaaagcaggacaaacttgtgctgtaatacaattcaattaatttgatacgatgaggatttcagtgtttgaagaattgtaaaagtattaagttttttttctggtataatttatttctcaatagacttaaacgttggttcagttactttgattcttccccttttccttattcgtaaatcaatgagaactgtattggtacaaatcaattcaagaaagcaatccctcttctcagatgctggtttggaatattagtaccgattgatgcagtgtatgtttttttccttacgttctagaggtgaccacttcttctttgctgtcttacctcttttatcatctaactgaagatgctttcaaaatatggacaacagacaaagataaaaagtacttgttgatattagacttatcaaaaaaatatgtcaaaggaaaaaattaataaaaatgttcaatggaagatgatctgctcagcaaagaaacaaatacctatgaagatcacaagttagtggtaatatgttcctttcagtttcttcaaaaaaaaaaaactgcaaccggctaatttgagtagcacaaaatctttgcaattgtcttctgaattttaattctcaccttttgatcagacttttattttttttttgcaggtgaacgttcccctttgtctgaatgtacctggaattaacagaatctgaattgaatcttagttcaaatctattcaaaaagcctatcggggttcacttaatgtctgcaacgtagacacttggatgtgggaaggtgataatatatttataagctggagacgggaagaaattcaaatgaaaagttgcagtagctggtttgcgttttttcttttaccctctttccttcctcaacagtaacattaggatgcatgagcgaaacacacaagtataaacaagaataataatacgctcatgcaactgtactgatgcgcctcatccaaagatgccgatatttatgtttttttttcgctttgttgcctgcgagcatgaatggttttgaaagatacgaagacaaaccttaagcaatttgagaattgtttttttcggaatacatcaaagatcccagccatgaaaggcttacttgcttcgatgtacctgtggcattttatggatcgctagcgagcataagttaagttactaagaagctttcaaaaatgaggaaagaagggaatacgctgaggggagtgcatcggaagcagcaaaatatgctataaacggcatactgcgcgcctcggtcgtacgcatacaaccatgatggtagcctcttctttccatactccagtacagatatgcacttactattgtattataaattacggataccacaaacaaaggctttttacttcctcagatgtaagagcagaatcaaaatgactggtaaaaactgaaaatatgaaaagataaaatcatagtatacctcgtggtaattatagtagtcgaatcattggcaacaacatccaaaggcgcaacgtaaggaacaattcaagaaaagaaattctacacagatctataaaggtcgagcagaataaacagcgaaacaaaatagtagtgcacaagatacaaacgacagaaacattctttccacatgacagatcaaaagaaacgctagttttatttgcacagtatctatactgtgagaaaaaaaaaagattgcaaagtggatgatatcaataaaaccgttcttaattgcttcgacgcaactaagaaaagaaaacctatgaaaaacgagtacacaaaaacagaaaaaaaaacctagaaaaaaagtatgcactaaagaccgatctcttctcgattagttctatgtttgagttacttctagctgttttccagctgcaaaatgtatatatgatgatagtcgcttgtatcggaatacatgttcataatgccctttattattcttttctcttgtacacgacatgacatagtctatcccaaaggaatacgtagcaatatcccggtatgttttcgtatctggtcatatatatttttcatgagctgaacaattccgatctaaagattcgaaattacagaaagtgacctttaaggccatacgatccgaataggtatatcttcgggatacaagggaattagacacgactggcactaaaagactacttctcttcacttgtgctctatcttgtttataaccgacttcattaagactaaaattagcggttgcggctgatttagtctccggcgtcagtttctagttagatttcagttcctatttttcgatcaattgtgtattttttttgcttgccccatgttaaaaattgcatcgactcttacttccagatctttcatttctggcgatgaacccttcaggctacgtaaggatctgtgtttcataagcaagtgagggtttgccggcacggaacgtacaaacacagaacgtttaccaaattggtaggataatgctttctccgttaacacctttcttctgccggctaaatgcccagtggccaacaatgtaccgggtgaactgcacctgacaaacacgaagaaagatttttcagttccctgtttgtcctctgttcagcccctgtgaaccgattttaaacccgaacaaattattgatccagtttcagtgttcattccctatacaaagtgcggctgaatcgctcgttaaaaaaagagaatcagctttacttgcttcacatcaacctacgttagctcaaaatgcactacaagacgcaacaggattgttcattgtctgaaaaatttctcatggggaccgcatgcgtgttgtcgtgccatttgtagaatctagtttaaagttccgacaaaacaatgcggtgctagttaaaagactttcaacgggatagtaatgaggagctaactttagcagaatggcctatagggaaagacggtaattcaacttcagctcgttcagaattgctcactattcactgtagtgttttccgttgttatttcaatcttggaagcgatcactcagacgaatcggtattacttattttcatgttccttcggagaaaatttctttttcattacttatcgcattctttactgtattcgaacaaattattccgaccggcgctggtaaccagcgagctgaatcggtatgtgaacttgaattgcataaaatgctgattttgcggacattaagctgagaagagaatggagcgttctcttttacagtctgatatgccaaaattttacaagaaatatcgaataagaagccatttcatcagattaccgtttttgtcaaaaaaaaaaaaatacaaagtatgattggtgcgccagtattgattattgttttgcacaatggggttcttttcgttgaaaatattgtttgcgtatctcgagtgttgcctgagttacgcgttttatgtaccttattcttgcatatttataaggcattatttgcgttttcaagttcgaaacttgcaaattatgttttgagagtttccaaatgggtactgaaaacaaagatcttcacgtgttactgcaaaggcagaaggcaaagtaaatgaatcgatcttaatggaaaagcacacattaaccattcttttggggttttcttaccggagttacttttagaacatacgctgtacaaaaatggctaatctggatggacttacactagttttggtattagttctgcatggatcaggacgaagaaaagaaacgaatgtgatgtttgagttctaattccattgcaattgcatgttcggtctgtttgcgcgtggaaaagaaaaaacttcattcgacaattgaatccggtaaatgatacaaatgtaaatgacaaagtttgacttaccattcacaaggggagaattggtctcagggttaaatttttaaactacgcatttcatgcagtaaaaaaaaacgtaatagctgtaccttctttccaaaaaaaaaatacgctgataaaatgtacataattcgatacagacagcaattatttaaatcgttgttcaccccttctctatcatttaacttcatcgacgagttttctgtacttctgttgagtagccgccatgtccaagaaaatcttgtacttggcgtttaacaaaagtctatctggagcatcctcttcagttggccacacaaccttaccacctcccgtcatattgtacataacttcccataacttgtccttggttacatcacgaaggactttggcattgttgtgatttgccgcagaagtagcagcctccttagacttttcagttttagcgtcaaatgtcaacagcgattcgtcttcattttcctcttccatttcatcgatgattgcctcctcattactggccatcacagggaatggataacccccagtggtagaaatttgtgcagtggatgatgttgcagaaggagcagtgtaaggacttggcatgtcagcaaatttcaagtcgtttgtcttcttctgtgcctttgcgaaactagttaatggtttgagggtattgccaccaccgtgtcctaaccctgatgcagctgacccagaacgtgatctggatccatctcctataataccagcatcctttctgctcaaagaactcttacgacgaatggagacgtccttatttgaagttgttgcagggtcggatgctgtctcttcaagtttagcacatgcattaaaggactcgcttgccactgcccctagtaaggcagaaccaaatacgacagcggcgtcgatgtaccttggaatcacaattggtaaaccggtacagtctgccaacaatctcattaataacccatttctgcattgtcctcctgacatgaagatggcagctaattcatgtcctgaattacacatttgctcgacaatttgtctcgtttgttgtgcaatgaattcacaagctcccaaatacattatggatagatcatcgatagagttgtccatagattgaccaatgatagcggcacgcatagatggatcagcgattggagatctattcccatgataatcaccgtaaaagaatagatgcttggccaatgcaacaacggagctagctttgcgctgttgagccaatagctctaatcttgaatttaaataatcgaacttagagacgtttgctgcatctgaaagttgagaaagctcggcgtatgctggatgggtagttaaaacgtgggctaataatgcacctgtgcatgattgaccaccctcagctaaccaaaacccaggagccataacatctctgtaaggtccccaaacacctttaacaaatattgggtcctttgacatggcaatatgacatgtcgaagtaccagctacggcagccaaacggcctgtggcacggtcaattccatgcttcacttcatcggatttgaccaaagctgggatttcaacgtcggtacgggcggccactgttccgacccacccggcatatgcatcgataacacctgaaccgacgacacaatgagtactcaaacctaattcagcagcagattcctccgtcaatgtaccgatacattcaccagcggacaggaaagtggtttctgttactgaaccaccaagcttggcaaaatcatctgcaatcaactcttccaatcctatttcttgtaagaactctttagaccaaccgttcttagatccttctactccaagtggcaatagaccttgcttacaaacggtagaacagtaggatctgatctctgacccggtagctttgaaagttaagtagtcagccaaatcgaagaatttgcactgagcaaacttcttctccggaatgttgtttttcaaccatttgatctttggaatttccatttcaacactcatttggccacctacgtacttcaaacatttatcaccagtggcattaatctcctcggtctcttcgatagctctgtgatccatccacaagattatattttgtaagttgtcagtaaaatcaggaccaacaccgacgtcctcgttgttattatcaacaacgactaacgaacaagtcgcgtcgaacccaatcccatgaatagttctaggatcgacgccagagtctctgacaacgttcttaacacagtaacagatcgcattccagatctcttgagacgattgagtgatatagtttggtttcaactcgtgcctttgaattggcctctcagctagcgaaagaatattccccaaattatcgatcacacaggcacgcgctgatcctgtaccaacgtcaacacctacatagtaaaccattttacgctcattttgaagcgataacccactcatagagtgggaaagcaatctctgttgcgagatagacaacgaagaatgtgactttctcgaaccaaacatgtcgttcccttgttaaccccgctttatttcttgagttggttttctcaattaacaatcagttctctattctggatgttaaacgttcagtgacaagttgaattgaaatgaacactaaaccatttagccctgtgcttttatataaccgattgcgatttctaactataagtaaaagaatagattgtctctgtgtaacatttaccttaatatatcaaaaaatacgtaataagctttcctttcacagctctttctaaacaagctttatcttttttctttttcttggctttcttccttatttctttccgaagccaaatagagcaatcatgggaattcagaggattacggaagttcggaacaattgtgcaaagcgcgttgcatgtgagagagtactaaagaacactcgagaagcgacctgtaatgagcgcattgcagatactctaccctcctgagctttgctccatcaagttgtcttgtttttgtgtatatgagtatgtgtggtttctccgtatgtgaaatataggggtacttcatagaggcaggaggggatcatagtttttttacccggatttgaatttccgctactaaaaaataataccgtagcagtagcagtttcatttgatatcacgtgagcgtttgtgaaattgaacctatgcatatatactctatatacacgaaagccgtggttgcgatcacatggttacaaccactgttggtagccaaatctgttcttggtgcaccaatcgagcccgtgttctagatattcttctcttgtgacccttgctgagcggaactgatccgagttggcaaagtctttcatgctttcccatccgtgtagagatttgtccttttcctggggtgaatgtactttgcagctccagtctatcggacattgtctttgtaattctgtttgtaatcgctcgtggaagtttggaatgttaaaattgcctccggtgcatactatattggcaacaagtaatggtctgacgacttcgggacacatgttgatgcattctagaattgtttcgacgattcctggttttaaaatctgtgcaatttcaggatgaaagaacgtttctggtaccgagaagacttcatctgtgagtaataaggtctgtgcatcatccgtgagcttttctttacctggtttcttaacgtaccccaagaaactcgtttggaagtccggtagtacatactcgacctttgtgttcattttgttgtggaaacttgaaaaatatgattcagggggaacaaaagtacattgctccttgatgttatttacaagtattgtctcttccatcacattgtaatgcctaaacgaaatggtttcctgtaataggcctgttaaaaatctgccaccgatgtcgagtttcttgatagctttgtaatacggtactccctttattataggaacagcccatgtgcagttaaaccccgagtctataactaattggaagtccttgtatgaactagttttcttgtcttcagcagcggtcattgcgtcatcttgatattgaccctggtaaaaaggaatatattgtgctacaggtcctttgaacatagatttgaaatcatattcttcgaatattacctggtccatgtttttcgaaagctctggtatcgtcatgagcgtctcacttactactaaatgatgatctttagtgtcattgtcgtgtgtcaagttccaatggaagtcgtcctcgttgtaaaaacagtaatcccatacttcactttctaattcccatgatacaagttgacccaattcgtgaggccttcttattaaagcctgcgatatatcccgcattttcttcgtttgatttgaaaggtggaagcgagagtatttgtccttggttaagcagtttaacgctcgcagtggctgatcccatccactctcaccaaatttgatttcatacgatccgttatcgatcaccaatacaggctcactcattttaatagatgtatgattatattattcccattaaattatcccatatagccaatttggcaaatcatcaggacattcaaagaagcgcgcatgcagattgcctgtgtttttctgtagtagtgctacaatttttcttcatttcctttttgttatttttcaaatttcatgttttgaaaagattgtttgtttaccaaacaatcatgatgtaaaccaaagaacttttaatattctatcatgatggcgatggcgatggcaaaccaccacagccaacgagcacctcgacctgtaaagctattattctggttgcctcctgtagctgcactatagcttgattgatatgactgcagacagttctgtgccgcatctgggagactcaccagaaataaagaggcaaagagtatcacaatcgccaacaaggacgccaaggaagttggttttgggctcacctgaaaaaaaatatgccgtctctaattcacaggctactactgccgcttctaatacaatggatccaccgagtctgcaacctcctacggcacatgctgtacgagggcgcgaatacagtcagtctccgcctaggtctcctacgcgatcacctactagatctccgacaagaaagcttgaattgatcagactttcacccaaaaaaagtacacgacttgaattacaaaagatgcacgaggccaatactcagacctcacagcgattatgcattgataaattggttttgaataatttcaagtcgtatgctggtattcaagagattggaccattccacacatcattttctgcagttgttggtcctaatggatcaggaaaatctaatgttatcgattcaatgctttttgtcttcggttttagagccaataaaatgaggcaagggaaactctccgagttaattcacaaatctgagcagttcccgagtctggcatcctgttctgtccaaattcattttcattacgttcatgatacagataatggtgaaaccaagattcttccatcggctggtacaatggtggttgaaagaagagcattcaaaaacaactcttcaaagtactatgttaacgggaaagagagtaattatactgaagtaacaagacttttaaaagaggaaggaattgatttggaccataaaagattcttgattcttcaaggtgaagtggaatcgattgcccagatgaaggccaaggctgaaaaggacaacgatgatggacttttggaatatttggaagatataattggcacagctaaattcaaaccgcaaatcgagaagtgtctagaagagatagaaactttgaatgaggtttgcatggagaaagaaaataggttcgaattggtagataaagagaagcagaatcttgaatctggcaaagaagaagcactggaatttcttgacaaagagagaaaacatactatattaaaggctcaactacttcagcgccaaatttatgacagtaaccgtaaattggcaacgagctgtgataaaatatctgcgttgaacatggaatttcaagaggaaaagagtcaatatgaacatttacaaaaggaagctgaaaccctgacacatgaaataaacaataccaagaaagaaagcaccgcattagaaactgaatctaaaaacgtgaattcaaaaaaacgttctttagaaaaggattttattgccacagatgaaaaacttaaaagtattgcaagaaaattaaaggctgcggagaaggcattctcccaatcggaatccaacggtaaagcagcagtcaatgaaattgagtcgttaaaaaagaatcatgatgattgtgaaatagaacttcacaatctcaatcactctatcagtattgagaaggaaaaacttaatgaaatcaaaattcatttgcatgaaaaaaccaaagatctatcgcaggagatggaatccttggaaagacagttagaaccttttagggatcagatacaggaaaaacaatctgaaattaaactttcagaaacaaagatcacaatgttgaaatccagtcacagtaatttgctgaaagaaaaagctaccattgaaagtaagatagaagatctgcaacttgaagagctgaaacagaaagagacagaaacttctttacgaaacgaaaaatccaaggtcgaggccaggatatccactgctcaaaaggagtgtgaagaagcccaaaaacaaacgaatgaaatgcgagatgttttgattcaacaacgacagattgttgaagaagccaaagctaacctcaatgggttccaaaacaaaaatagagtcctacttgctcttacaaaattgcagaattcaggacgtataaccggctttcacgggaggttgggagatttaggcacgattgatgatcaatacgatattgctatatcaaccgcttgtcccaggttagacgatatagttgtagaaactgtggaatgcgggcagcaatgtatagatcacttgaggaaaaataagttagggtatgggcgtttcattctcttggataaattacgtaaatgcaatttggacagaatagccactcctgaaaatgtacctaggctttttgatcttataacccctgtccgtgatttattccgacctgcattctactcagttctcagagatacgttagttgccagggatttacagcaagctaatcgagtagcctacgggaaaagaaggttcagagtggtcacgttggatgggaaattaatcgatatttccggtacaatgtcaggagggggttcttctccccaaagtggcttaatgagatcaaaagctactacggcaagtcaatattctcgcgatgaagtggagaaaatggaagtacaactttcaaccaaagaaactaattataggtcagctctatcgatggtccatgagatggaatctgcattacaaaagttaacagatcgtcttccggagattgatattcagatttccaaaatacaacttgagaaaggatctcgggtcgctgaggtggaatcctatcaccaacgactatcacagcttgctagggaactttctatgaacgagaagaatcaacagccactgttggatgaagagaagaaactagatattttgagacaacatttgcagcaaacaattgatgcttcaaagtttagccaagataagattgatgatctcaaggatagaatcatgcagaaaggaggaattgagctcaagatgcaaatcgcaaaagttgcctcacttgaacaacacattgaaattttacatgaaaagcagaaaaaggagaagaccagaagtaagaagcttgacattgatctggctagagcgactagggaaaagaacaaatattcggaagaagttctagtctgtaataaggatatttcaatactttccgaacaattggaatcaattcgactggaaaaggaaagaattgaagaacaagtaatcgaaaacaatgaaagaaaagcagagttgaactctagcgtggagaaattgaaacaagagcttctttctattgaaagagattccaatgagtttaaagcaaaagaattagagtactcagatagattagagaagttgcatgggctacaagagtatgttaaaaaacagctgagaagttatgaaacctcactacaaagtcttaaaatcagagacgtttccaaacttttaagtcaattgaatgacggaataattgagtcatgcacagatgtaactgctaaggtaatgaatggtgacatagttcaaacgcagtctatcacagatgtcggaaataatgacgctatggaagattctggtgaagctgcaacccacagcgggttaccaagtttgacggaaaccgagttggaaaatctcgatttagaaactctagaacttgaacttcatcaattacaagactacttggataactttaacggagatatagaagtactagaggaatacgcacgcaggcttgcagaataccaacgtcgaaaactagacttaaatcaagcagttgccaaaagggaagaagtaagaaataagtgtgaaagtttcaagaatgagagactagagaaatttatggaaggtttcggcatcatatctatgactctaaaggaaatgtatcagatgattaccatgggtggcaatgcagagctagaacttgttgatagtcttgatcccttttcggagggtgtattattcagcgtcatgccacctaaaaaatcttggagaaatatctccaatttatcgggtggtgagaaaactttgagctctctagcattggtatttgctcttcataagtacaagcctacacccttgtatgttatggatgaaatagatgctgccttagattttcggaatgtctcgattgtggctaattacatcaaagaacgaacaaaaaatgctcaatttattgttatctcactaagaaataacatgtttgagttagctcaaaatttagtgggaatatataaaaacaacaatatgactaaaagtacaaccctacagaatattgatattttacatagttcctaaattatcccctaatgtacgattgtactgatcttcagcaacatagattagcttctgtaatggaaccactatcaattgatgtgccataccagggaatcttttcctgttaactccaaaccattcaataggcggtgtagcatttcctagatcccttaaaagtggcatctcgatgtgtggctcttccaaaggaatatatttatattttgtgccaagattcacaattttgatcttttcagcaatgttttcgtcttcgaaaaagggctttgatggagatggctcagtgtgacctcgtcttacagataatgcacgtacatgggtcgcccacatttccctgatgaagttaattgggtcgagattccacttgatatcgactttatccccaaaactactggaatacaagaactcaatgtctgtgtcagggattttctgccaagtggtaattccaacaaatactgagggagccgctagaattatgtctccttctaaaagagcagcttgtctgttgtactcttcgacgctcaattcagcaaactgctcttcagttaactcattcttaaactgagccaaactgatatttatgtcgcgtatttgccatgttagatctgttttcgttttttgctcagtctgagttgcggcttcaacattcattttatttgccttcagcaccaatacttcgctatcaaataaagtacttggaaaaacatatagcctgaaagatcctatttcagcagtcaaattagttcttaaacgaagtggcgccagtaattcattatttgagaaatgaatctttcccgaactttcaggatttgattcctttagggtctgtacgtaagactttttattttcgatcctcattctggcaaatgttgcatagatatcgtagagattagcagaagccaaagccgttaagaaaatattaacggatccaaatgacatggatacaattaacaaatctttcaataatccactttcatccctctcgttacgaatagctaattgcaaatccgacacacgagcgattaaaaaagagtggtaatcgaatccaatttttgaagacaggtggctcattttgaaggctaaatttatcaaaggcgcctcgaatttattgtctttaaccggccagcttatactagagtcaaaaaatatgtttttaatttcaaacaatccacctaaacgaccatcagacttcgagtttaattcatccagataaaagctgacagagtgagaccaatcaactctgtggtgagacgatatccaaaatgtaggcactttgaaattaattgaacctagcgatggatccatatcaattacagctgaagtgtttttgaagattatttggtaaatccacggaattttaggagttgtgaattcggtcagagcttgaggttggcatttttgcccagagtgtggtccagatcctagtttctgagcttttttagtctttggagaccatatgtcaagaaataaagtgatctcttgcaactgtttcatattaacgtaaaatttcatgtcggatatcagagtatttccatatgttttgatggtgttttcgtgtgttaacataaaatcaagatatacttcatttatacccgctgaagaactgatttcacgagaaaaaatatgtctggtactgatttcaatttctgaccattgtagtgatagagacagcggttcggaatgatctggtgagtcggtaaacatcgagattctgaagttactgaagcctaggtctgcttgaatttttgctcttggctcacatgtcaatgtgatattttgagctccaacgtttatcactatcgctgtgtcaatttttttgaataaatttttgtagtcgaaagaaatgcgctgagtattagttgtctgttcttgagttttatggaccaattgcttcttttcagagttaaatctttccatctgtttctggatttctgttgtgagatttactaaaactggaacgcaggatgaaaacaaaatgttgtgagttgattcaacatttactagacttctgatccaatgctgcttctgcgaagggaagttgtgcatatagtccaaggaaacttctattgatggactagtgagctctagcgacgatttgggagaatcttgtgcaatatcatcgggagtgtaaagatttattataccacctccatatttggcaatacaatttattgaacgaattgaaaggattgagactttgtcacttaaattctcagccacattatgtgttgatatcgaacttttcttaatattactgatttttgccagcttcttttgaaagctctctattgaagacctcataacgtttacaatttctaccgaagttgtcagtattctgacatctagcttgtctgcgttcattcgaacaaacaagtctttttctatgaattgaccagaaaaccaaaaatttatctgcatgctggacaaatggcttcggttcagttctggaacgccatttgcaaaaaagaagttattggattccttcccttgtgccgtagccacatacccatcgacaatagtaagttttccgtaaggtttctcgtacgcagcgaacaagctttcgtatccaattactatcccattttcatcggtatcttcctcgaagatccaaccgagacatagtttattggaaagaatgttgactgataatgtctcgaagtaaggaggaatttcgattgcattggaagaactgttaaactttcccttttgtttaactttctgaagtgaaacttttgcttcctgtatgaagaatattacagcaataagcgtggaaggggccaacataactctcgaatgaggggtttctatctgtagtgtcttctttatatcgtcttctataagtttcagtgcaaatccaatatcgaatatcttagacaaagttggcaaaacttcgggatttagtacaaggatacaaacattttgaattaccaacgacatctcgcggagattgtcatttgcatgcgtttcttctaaagcctctgctcttgatgcgcaagagaatgcagtttcattaaattctagaacataatttgttgttttcaagtcagttagcaggccaatgtatattgcattcattttaaaactgcaaggcttgaactttggtgcagctggttcattgtctgcattcttgttcttgaaaatcttaattagttcagataccgtaccatttagactgtcggtgagttcttcaatgtaaacacggttatctgatagtgtcaatttcacgatgtcagtgtctaatccaatgtcagtcagcaaagtattacttctataatctaccttcgtgacagaattggagattcgcaacaatttcaactggttaaaatagaagtccaacaaaagctctgtataattcacaataattgaaataccagaaagatttttgaaattgaagtctaaaccactgatcagaatgcgtataataaaaggaacaaaagccgaagtttgaagttgcaatgatccaaccttcagggagagaacccatactaagtcgacgtgaccattttttttttctgaatcatggtcgggagtaatggctttcatatcatctattgaagctaggagggcccgagcatgcttcatcatttcggttaaggttaggtctgatgagtctagtactacactaccaatatttgaagtgaagaacctgatattttcattttctgtgccaaagaaatttgctgtaactttctcaagcagaattcttgagatgatacggtcaagatacaacaaattgaatgaaagagtttctgatgagaacttggcagataacaacgaatttatttcagatgatgtttctaaacccgcaattgacaagtcttgtaggtccaaaagcatcatatatttttcaattagcatgtgcaaagtcagctgagatattcgaaaagatgtctgataaatttttgaaacccaacgatttgttttgttttcaatgtcggtaatttgagggaaaagcttctgtttcaacaaaataattctttcaataagttgcatactggcgcgtatgtcagcataggaaattagtaaatcgaagtctatttctttcttatcatatcccattgtatcgaagtctagtatcgcatcatgtgacatcttttttacacacaaatcaatttgtttggcaatgattgaggattgctgtggtgcatatggcagttccaaatgtagcatttccaatgatagcgataattcattgaataaatcctcctcatgaacagtactctcacctgaaaatagtaatgtaaacaatgagctttgttccacttcatacacatcccaatttttccagtcaacaaatatatccaaaaactgtgatttatccttgcagatgtttctaacttcctctgggatgtcatcgcattgtgaagttgtttcggacacatgcgacgtatgcttagaaacatgtcttagccgcgttatgatcttccagcttgcagtatcacgcacatgaaattttgacaatctcgtaatatatgctggtttggtaataatgtaagggactgagtcgataccagaaatctttcccaattcagcaacccggataattgtttctttcatgtcgatgcttcttaacttgcctaattcgatacatgactttccttctttgcaaaatgcttttgctagtttaaggagatactctaccgtccattcgacatctgcgtctaaaatagctgatttgatagaaccgaaaattaatttcgaaactttccctacatcggaaaataatactgtattgaacatcaatatctcaaaccaggcaatcggtagcaccttggttaacctattttttgaagatttgaaaatgttaaactgtagactatcgaaattgcacgaaatcgtagagtcatctgtaattcctgtactctcattgctctgttctaggttctgtggatattttaaaattttagaaattactgatatatttgatactgaaagctctaagcggtcaagagcttccaattgtgttttgtctagtgcagtttcatcggatatgttaacttttacgtttttgagcatgacagatgaattaaaaaactttccgttcgtaatgtgacctacggagaatatattaacaatgttcatttcaaaatagtccattatgctctcagtagacattgttagcatgaaatgagcggcgttttcagcgaaggtaaatgccttgggggtaacaaaaacggacaaggttgaaatattcacagttgtattttccgattcaaattcttcggcaagctgtccacttaagtcattcgaaacagtattcgatagcggtaaaagacgtttatcatcaggtctatcatctgtaagatttttagtatctataatgtcagtgtcaaaattgataaggttaatataactccccaataagcgctcgtaaatattatcgaaagtctgaaacgttaatggttctgagagtgtgggcaaagaaatgctaggagtaattgatccaagtagatcatcatatagggtagaatgattgagctgatcaaaagctaaaagaaacttacatcggtggaaaggggaatcatttaaaagtacgcagttctgttgtgtcactcgatgatttttcatattgctccgaacaacgaatttagtgagctctacggcggtgtcgcaggtgaataaaacagtcttcttttcatctatcgcacaaactgaaatagcagccaccagtaagtcaactcgttttgaatatcttgagttacttagatcccaggagttgatagtgatatcatttaatgacagagtcgcagacccgccgtgattggtacgtacaatggaggaaactcttccaattgatattgtcaatgatgttacatcctctggtttgtggatgctgtatatcagaatattttcggcatctttatacgtaaatcccactttttgaatagcttccaggaatgaaaataaaaactgtccatcagagtcagtagaaagcgagccaattgaaatgtcccatttgcaaaggtacgtttcttccactggaggtacaccaaacatcctatgaccatgcaaatttaagtcatctaggtaaccagtgttttctgaatgagattcctctatcgccacaactctattaaaggaaaattcattactatgatttaagtatattcttgagaaaaaagctgtcaaatccataaaataattagtatatctcatatcaaactccaacctacggaatgataataagaaagacctttgacaatcgtaaaggttttctggaattattatgcatccatcattaacgaaaaaggtgatccaaacgtctgtctcgtttttggttctcaatagcgatgatttgtgaatagtattttcattaatggtgtcagcaacctgatatgagccatcactcgaggaagaagtcaatgattcgacatcattagtcggttgctcttgaaagtttttggttttagttttggtgtcttcctccatactcaaatcattactgtattcttctgtcgttttaaaatggttaaagtccccaaaataattgagcttgatgttcattaagtatctgagcacaaatccaaaggacaagaacttcgtagaggaacttcgaaaatcgataagtatcgtgtccgtgttgtcaacatcaaccgacggaaatgaaatataagttcctgtcattgaaaagtccgggcattctccaaacgtcgtttcagagaggaattcatggagagtattccaacacggaggatgtatagagagctttacaagaggacttttgagtaagaaagtagtttcgtgtggctccttgacaattgacgtgaatgggagattaattgacgtattcaatatgtcaccgctcaaagacaaaaaacaattctcattcaaatcaagaaggttattgatgatatttgcgtcatttacgttcagaaatagtttgtattctgtaaaaacccactttatctcgtaagtgaagggtctaaacaattcatatctcagagcatcattcgcagaaaaatcggtaaaaagatcagaaattaagctaatatgatctcggagaagaaacagttctgcagtcctactatcaagctcaaacaaccagtccgcctgtttgttccaacctgttggatatccaatattcgctttaatagtctgggtgttgcatctaaatagcacttcatgattaacactagattttatttccggatttagtaaaaggacgtagagctcatttggtagccggtcggcttgggaacataatgcaagattgaaaagaatctctcctccctcgttgagagaaacattaagccaaccaaaggccctatgagtatctccagttgttttatatcttttgatgaactcttcatctttactagactctctagttggaatgtgcaacacgcttttgtctcgaaaatccacagataatttgaagttttcgtagattcttaacgatcccggttcgggttttgtagctttcatttgatctcgggatactattggagaaaaaagccgtataatatcctgcatatgtttatgagcccaggggccataatatactgctgctgtataaatgtgaatgtcagttccgaaagccggtgtgtcatcatcttggttgcaattcaaactttcatccctatcactctgagagttgatggaagagctgttagcaggtacaattcctggtatgtcaaagtaatatgtcaaagaaactctctctgctttcatcactctgctgtagcgtgcatattcctgttcatgaagcactgtcgtatcgacattttcctcttgaactgctttggtgtggtgatatagatcgagacccttccaagaatctatatacgcctgttgattgtttattgttttgccttggttgggtagcaaaagctttgaaatcgaaatgcattgttttttgacagtctgccaaattttatccatagttttttcaactacaaaagtcttgatgggattgtcattctggtatcctaaatttgttcttaactcaaatagggcgtcgtataaatccagtgatattttcgtcctgtagtagtccagatcgctaattgaggaaaaaatatcgtaaacaccttttgcttgctcgaatttgaaaacacctacatgtctggtgtttctattacccaaaacaatagctgccctgttagcttcaagctgtatggggaacagcttggttttggcagataatttgggtgcatccgtgctctttgagcggccagaataactatatcttgaactgttggataatttggaatttgcagcagctttttctgtatttatagttatatcatcgtttgattccgtttcctggccatctttcgtgacgttggtgaaatgatctcttagtactgattcgtaaacgtcaattttgttatatacgaaaacttcgagaccatcgcattgtaaaagaaacctgcaaggaagtttagcgttctcactcgcatctccatcttcactttcaaaatctattccgcgaatccttgtatgcaataaccaatatctccaggtaaaactaccctctaaaaatgagattgtaaaatcattcgagactactgttaaattcttgaagaagattcgtccacctagaaaggacacctttattgattgtaggtttattttaatcttatactgacgccatacccagaagtccaacccctttgtcagcacccatgctagaattctacctaagtaaaatggcgccaatatacataatattaccgcgagtatccaatccactaaaaagggtacactaagatccttctcgtccgatatagagatcggcctaaaggttgaactggaatccatgttgctgtatcatatgcgtttgtttcgatatatcagatgttgcttgtattgattattcattcatggttagcgtctgtcttgatcatatttcatcagtgaacaatatttcttgatatcaaaattgaaaaggcattttattttattgagacatattcagcaaacgataatggaagatagaactttaatacaaagttgcttcctgtagagccattgggtggcatttaatattctcagcctaataactagaacaaagtgattaagtaatggctttagtagaaaagttacatcgaagaatcatttcaattgggcttatcccaaaatttatctcgaagctttcacaattatcgttgttatgctgtgtcattggtttgggatggttggtatttatgttgccctcggacggccagtttaggagaacatacatatctgaaaacgccttacttccatctcaagcgtacagttactttcgagaatcagagtggaatatactaagaggatatagaacccagttggacttattccaatacgtatcaacaacgcatgatagtaatgctgaggtttctaaatggctgcaagagtttggggttaagactgctatatatgacgatgagcaatatggtgagactttgtacggtatctttcacgcaccaaggggtgatggtaccgaggcaatggttattgctgcaccgtggtataacgagaatcgtgaatataacactggtggtgcagctcttgcaatttcattggtgagatttttctcacgttggccagtctggtcaaagaatattatcatcgttctaagtgaagatcctaaggcatctttgagatcgtgggtcacagcatatcatacgtccttagatttgacaggcggttcaattgaatcagccatagttcttgactacccaggtaccagtgacagattcgattatatggaaatacactacgatggattgaacggtgaaactccgaacttagatttggtcaacgtggctgtacatattgctgaacacgaaggcattaaggtgtccttacacggtttgccattctcagaacttgatagaaatgactataactcgagattgaaaacgatgcttttgggaataaaagactcagtactttctggaatcaagaactgttacggtaatgaagcatttagtggttggagaatccaatcattgactttaaaggctaaggggattgatggaccacacgacatcacaacatttggtcgtgtgccagaggcattgtctagatctgtcaataacttgcttgaaaaattccatcaatcattcttcttttatcttctactagcacctcggtattttatatcaatcgggacttatttggcgactgcggtggctgtctcggtggcctttgtattcgcagcattaaatcaaattttgaataacaaatatggtgaacttccgttgctgtctatatacaacatttggtcaattctaacattctgcatttctttggtatttgcctttgctacttcgcaactattcgtttatttccctctacctcgagtccttttgggactcagtggtatattttcggtgcttccgctgctttcgagaactagactaagaatccaagaacctttctcatacagatttaaagctttcgcatacatctatatggccattgttttgacttctctattagtattgaatttctcacttgcgattgtgatgggcttgcttgcattcccaatgacaagaactacgacaattatcgagagtaatctaaggctgtcgataaaaaaccttgtcttgcttataatatccaatcctttcattgcaacttgggcagtggtgaacttcgtggaaccaagattatctggtttcaaggttttttacgcccttattgaagcttcgcaacagttggggtgttggacatggtacatcatttgcttaggatggtatccgagctggttactagtaacgtatgctagtattgatgccattgaagtgcagacgcccataaaaaaagaataaacgtctatattttagcaacaagtgttatataaaaacaaaaactactcatcagcaaaaggggcccgcttattatcatcgtgtgtacatatatgtaattgctcatatatactgagaagctttttaccatgcttattatgtttagagtatgatcgagatcaatttgttaatgctaagcaaaaccgaaaaaaaaaagtttgtaacgggttctttcatcagcttcagcgtttaaagtaaccattctcaacctaatgaagcatagcctggttgttccaatctctgcagtgactatataagatattgttcagaataaggtaatttgttcttcgtatcatttcaaggtatgaatattagtgatactgctgataaaactaccaacaaagagaagtctgggacaaccgatgagatgacatcggagaaagataaacttttgggaatcagaagtccggaaggcgaagtagctttgtaccctgctagtgctagtacagaatctactgaacctgattttaaatttgttctgcctgtcaaaggttttgatttaggaagcttttgcggagaattggatcaagacatgttaattgaaggtagattacaactggaaaaagagattaacaccgttaaaggtcaactaacacaaccaatatacgacttactgcactctgatgccttaaccaaagagaatctactcagagccagtgataaagttactaactctactgtggagaataaattcgtattgctaaagagacgctactacgttcaagagaatttactacacgatgtgaagcgtaaagatttagtagtatatgagccaaatgagctattcgacttaataatgtctgttcatgtactgaattcacatgtttcgtctaagggaatctacaatgaactttcgaccttctacgcaaacgtcactcaatcgttctgtaagttagtgacatcgttttgttctaaatgtaatgaaagtgggaacaagataagctataaaaaatttaaacacgagaatatacatgcaaatctaattccattgggtaggtgtcatgttgaaatctttgcaccttttgattcggcctatcaagggaacgacaacacggacgagttaaaaattgaaggaaaatatccatttgttctgtattgtagggattattactcaaggtatgtctggttagaacccttgaaaagtgttaccttatctgatctattgccagtgatgacaaaattattgttttccatgattaggatgcccatctttatcgacacatgtactttggatagacaggatatgttcgatgtttgtgagaatattgcaagaatatacaaaattaagatcggactcggaatgaacagctctaccagctttcagaaaactggaatcaaaagaatgaaatcgttattcctccaacataaggaagaatgtttacatgattggaacatgtgtttaaagttggttgtttcgagactaaaccaaaattattcagacagagttcgtggtgttccaagcgatttactatgttcaacacaacaagatttacataagaagttcaggacgttacaaagaaatgtcatctctagactgctggggcatcatgttgttcaatttgaagaagctggtggaatgatttaccttgaagatgaaaatagcccaaatctacttctttccggagatgacaatagtgaggaatcagagcatgattcagaaatattcgatgagctggcctcttctcgagatggtactccaatttctgaacaaccttcaccacaccgaacgaacatgaattatgatgggataaatcaagaatcggagaaacacaggataacaaaaaagagatctaaaaaggtgagacgtcctttagatcaagacaagcatgctacgcgagcgtccgtatacaacccgtataacattgctgacgtttctatggagctatgatggtatgtttttttagagtaaccgtaatacaattataaaaattcttcataaaagaatacttgatgatagatatttagatttaatgtaatttataccaaaatttttgattaaagttcaaattaaagaagttgcgatttatgttggcccgtccaaagcgggaaaattgaaataaaagtgacaaacgaatggtttataagccggtcaaatattaaatgcaagttaatacagccaattcgtatgtgttgcttgatcatgattcgtaactatttttgaaattttttagaatgaattgaagtggatgatgaagcatgctcaggcatacccagaacctaatcacggtacttgtcaaagaaggccttgtggaatttttcccatgtttctacccattcggtccctggtggtaggaatgtggttcttaagtgataagtacctgggacttgtccgaaaccagatcctggaacggtgcaaataccagtgttttctagtaatgctttacaataaaattcatcaggttccatttcaagatgctgagcttcctggataactttataaggaagatcgagttttggatataggtacatggcaccttgaggtttacggcattcaataccttccaatctagagaatgtttcgaaaagtttagaggcacgttcgtccaatgcgtcatgaatatcttcacgttcctgttgatcttgttcgtaagattcatcacctggttgaggtggagataccattaagtccaccaaggcttgaccggtaaccacgggacataaagaaatagaagccaattttaagaatacctgtctgatatcatgattgaatccgaccaattccatataaccacctctttgaccacattcacccgagacacctttggaagtagagtgtagagaagctaattgaatgttgtcgtattgtccatgataagtcttttgcaagtttctcaaaacttttttcattgagtagaatttagagcctttgaatacgttttcttgatacacttcatcagcgatgacgacaataccgtacttggcagcgacttcgaagatcttttgaatggactgttctgaaaggatggcaccagttgggttacctggattaataacaactagacaggtgggtttaattcccttctgaattgcatccagcacgacttgttcaatttcttctgggtcagtggaccaattttgttcttctctcaagtagtatggtaaaggcctagagttatttagagccaaagatgctgtgtacaacgggtattgtgggataggtattaatacgccagtatttgggcccttgcatagaatggagagaatgtaagaaactgctgcagatgcaccagcagtgaggtaaatatcttctgggtaagatatttcaccgtcatctctcttcgtaatgaagtctgcaacggtttctcgaattccttgaacaccctgtgattgagagtaagcaccgacggatccaccaacctcagacaaaagtcttttggcacgcttaatggagtcagtcttatatagagtttgtaaagcctcatcagcttcttctagcagttctggatgttgcaatagagataatacttctctgtaaaaagtcaaaggtttttggtccaattgttgagggttaccgatgttggcactgataatcttagagaagggtaaagaacttggatcctttttcaactgatctctcaattcctcagccctcattggaattctacctctaacagcgtacttagccttcaaaacattttcattaacatcatctagcgaaagctttggagctggtttcacagtagtagaaaaacgcaattgggttaaacttgttacagaaggcattgtacttttcaaagctggagcattgactctaatcatgccagaactgatcctggtcttcaagttaactctgacagacaacatcttggaagtgtttgatggaaagctcttaacaaaaaatcaaagaaaagttttttttaactaaagagccaaattcctctcgaagctgaaggattaaaggaatactaaacgagtaacaggaaaacaagaaaattcgcccaactaaatctcgaatgaaatgcaatcgataaaggtcacctaaaatgtattctcgacctataggaactttctatcttctttttctttcagtgtcagaagtgggagaattcctttggcaaatctaactatgagtcaaaagatggaatggctgaccaaactgataacgaaaaactaaaaagtgaaaatatatcactcagtcacttactcgcgcacaactgtacgtaacaaatgaacaggtatgggaataatagcgtagtcccgtcttgatgatcgaacgaagtggaaacaaatgatggaggcaaggattcaaagtatcaaatcgctagtaaccctttatctttttttttcctcactctttacttctccaaagccttaaacccaaaagaaaaactacttgaatttactttgggactgtgttgatctgaaattcaatgcttatttcagcataaaagctcatcattttgaatataacaattgcattaaagcaaaatagtgctgtaaggaaaaacgatacaatccggcattgcacatcaagggtttgcagttttcataaccgaaaagtaagcatcaaccgcccagtatttatatactatgtaggactgatagaaaagtggacaggattccaagttttatctcggtgtagatactatttaaccattattaccaattttgcgggtatcttgttgcaatcaggcgcactttaacttccgactttccaccttaagcttttttttttccttcgccctacgcttaatacagtgtcgtgaaaatgaaaaagagccagtactcgaattagccgattccaattaatattgatatcaatggcaagggaaatactgcaattggaagcgacacaacgagcgagatatgtgatgcgagcgtaggcgctgattagaatggtgccgcgattaaaataactcccggttctggctcatttctttcaattgtaacggtgttgcccaagcggaggcttcagggaaagggcaacgccagggcaggaaatatttgttacccggttcacgttatggtacttttatctcaatactggaatgcagcaagggaaaagtatataggtcattatggatcacgtgatttatatgttgcgtataagtatgttgacacgattgattcgttaccactatatatatatatatatatatttgttgaagtattaaggtggtacaccacctttacattatattatagatcgttcactgttaatcttttctttgttgcatcttgaaatccaaactttcatacttaaaatgacatattccgttttcaatgttaaatattcggagcgatttagcagcagtaagccttatgtatttttcactacaggtagattttcggtattacatatatggaaatatcaaatgtttaaaaagcagtatgaacaagaaggacatgtagatgaagaaggagcaataggttgtaccaggctgaccaacagtaacgtgaactacgacatggcacagaccccatacgatgtgttaggagtagagaaggatgctactgaggtggagatcaggaaggcatatagaaagctggcattgaaataccatccggacaaaatcatcgatgaagccgaaagagagactagtgaagctatgtttaaagaggtgacagctgcctatgagattcttagcgatcctgagttgaagtccaggtatgatatgtatggggactctgcgtttggatctggaggcaatgggttccccgaagatgatcacgaatttgatgatttcatgaatttcttccagcagtaccagagacagcaacacggacctcacgcaagctattcaaacagacaccagtatggcgaaccagagagcaaacggactccggactcgagaatatcttataagatgactacacgacagttatacatgggtaagacagtaacgttccaactgaaacggaaatgtctatgtcctcactgcagtggtacggggttgagaaagaagcatttccagaaaccagagatttcctgtacatcttgtaatggacaaggtttcaaagaacggatcactcgtcttgctggtggatatatggtaaaggaccatactgtatgtgacgcttgtaaggggaagggcagatacaggaaaaaatccgcctctgacacttgtaagcattgttctggtaaaggactcatcaacgaagaaaaatctcaaactgtatatattccaagaggttctcgtcatggggatgagtttagactaccacagatggccgatatggaatacgggaaggaaactggggacgttatcatcgttattgatgaagattcctctaagtctcatttagaacggaagagtaatgacttgcatacaacgttaaacatttcgttagtagatgcgttaacaggtttctctacaattgtttgtgaaacttacgataacagaagattacgtgtaaatgtacccgcgggtaaagttattaggccaggaaattacttcaagtttaaaggcgaaggttggcccttatccaatggcgatagttttggtgatatgtacgtccagataaacatagagttccccaaggataattggttcaatgagaaatctgagataactgctttgagaaatatactccccgggttaaagtcaaaggatactaaggacccagatcctctaaatacagaagacgtcttgagttattctgttttgcattctcacgacgagttgccggattatttggcagaggagaaagaaaaatacaacagaaaacaacaagaagaaccacatgctagtgcgttcgataatgattatacacaaatgccgtctgaatgtgctacccaataagaagcaataaacgattctttcatttatgtactgtttcatttgacgtgatcaaagtccacgtccatcaataacctaatgtcaactattattctgaaatgaccactccatttatcagcagaagtaaaaaatacgtttactgtccccaagttttcttacttagcagtacctgtataaacttcttcttgcatatatttatttcgatacaagtaataaagttaaaccccaatgacttgcatactgatccactctccacggataacatgaaaaaatatacctcttgaactatttattacatgatataatacatctgcagcattatagtacccgttaatctaataaggaatttaattctagcgtatccaatccttgtccgttatattcctcaccaagttcgattgttatgctttcattatcagaatccagttctagattgtgcttgtgattgttatacctggtaggggaaacgagatcttcatctgtagcagctaaacttataagttctggatctctttcttctgtatcaaacgttattgattcaacctggaatggagatctatgatgctgaagtttctcgatggattccttatcaaaggggtcgtacccattaggtatatacggtagttctttttgtctcttgggtgcatactcaatgtttagttcatcttctttctctctgataagggcttttaatccgttgccaaacccaaggtttaacgattttccgctgggaaatatgggtaaatcatcctcctcatcctcctcatcttcgtcgtcattcttttcatttagctctgtatctttcagcaccaatgacttcgttcgtggcataaaagtgttcatccccaggacacttccgtatttcttcagtttattttcaggcatattcttcataaagctactggcgggcctttttaaagggtgatcactctttcccaacgcagcattattcttcacacttagtatagattgcgtcctgttattatctttgctagctagtgggcgtctgttgccccgtactaatgagtccgtccgcttcatctggtttagaggggtcctcagacccaaatcattgtcaggatcttggacggatatgatattctccttcccttcgttcggcatagctatttgaatctgtatatagccaatatctcttctagtctgacttcacgctagcttaacagacaaaattggaatatcttaccgttgattgctcggctttgaacgaccttgagctcttactgtttgtaaattttgagacagtttttgttatgtttgtatatttgtgttgttgtttttgatcgaatttggtgaatcaaactgagtatatgtggtgtatggatgttacggtgatactggatacatcttcattgcttagtactcatgaaaatactccaaaagaatccggaatgtcgcgatgctttgagactatgcccacgtcaacaaggagcagtagcagtgcctactacaaaatgtgagtttgtgtcgctgttcttcctggtttcgtttcgtgtctggctttccaaattgcaatatggaatagtaagtaggtacgaaaattttctagcctagagcacacacatgacgatcttcatacagagaacaggctcggaagaggttctgtattaatctaaagacgaaggttattactgtttaaaataggtcataatcgaatggacatactgtgaagtattgtgcgtatttttttgacaacagttttggaggttgacgatgaaggctagtcttctgagaacttcgaaattatacaagggtcttcattcaataactaaagacgccatttcgaaggtggacactttccccaagaataagcaacatgaaacgctacatcggttaaactctttcaatgagaatccaacacgcaagaccttggagaaattagtctattctgttcatttccatttgttgaacgatcctcctaaacacgtagacatattgagacaataccctaatgagttggcaaaattttggccctatgaaatgcagcactcgattttagaaatggatgacccaaatctaacatctcaaacgattttatggtctcgtaacaataaggatgctttggatttcttgagcttcaatcgtcataagtggctgcggccgaaaaactggcagactccgaatgaggaacttataaaagatatcacaggaattgacggtcttcaatcaactcaaattacagaagtattaagactccctgcagaaaagataaaggagacactacggcaaattttcgagcattactatttcttgaagacaaatccgaaactatgcgctacaaaaaaactccaggcaccaatcgttgagatcggaatgaaacctgatggtttcgatatagccgacatcaggatcgataacttgtttaagaaaaaggtcaagctaattagtgacctgctctactcgcaaaatccggtgctgacttcagatgcagagtctatattaacgtcaatagttaacgacccagatctcaataggcgaacgaaaagattgtataaaaatgttgccagcagatcttaccttttcaaagatgggaagttcgaaataagtgaacttgctagaggcggatttgtcctgtcgaaggaaaatttgagcgagaacttagctgctgcccttgaggaagaacataattgacttatgaacacacatcacgtgatatataatttacctacagctaccattttagctcaatgtaaatagaaaacactttaataataatgttagccaggaaatgaaaccgccaatacacttattgtaacagactagtctaagaccgatttgaagtttcagcggtttgctagaagccaagtttgttcgcttccacagatgctttcactatttccaacatccatcgatattttcatacatttacattagtctcgagaaagaaaaaatttgaattcaaagaaatcaaacgaagagaaaccaggacatatttcttgaagacgaagtctcctaaaagtagtcgcccgaactactcattagttatcgataaggatttaattcgaagtgaagaacaattaaaataaaatctcatccagtcgttatgagttttataacaagaaatcttcttcagtggacctcaaaacgtacattaaccagtttctctagtttctcacctttaagaacactagactcacgtcttcatagacctttggcgcaagtcaatccaatggaaatcactttacaatctcaaacacaagcaaatggctcatcaatatttggtatgttgttcgatttgactcagagaagatggaaaagtagaggtaacactttccaaccgagtactttaaagagaaagagaagagtggggttcctagcaagggcaagatctagaagtggacaacagatacttaaaagaagaaagaataaaggcagatggtatttgacttattagttctgttcaactttccaatcaaaccaggaacgttatggaagcgcctgattataaagaatggctgaatctcctgtatatatatccacatcgtcattatgtattttaagaaaacggaacagttttgattttagctttgccatcagaaagctggcatgacattaagatgattctatcggataggtttatagttatcaattgcagaaggaatcttttttctattaacgatttctatgtacatgggcattatttctgaagtaagtttcattctatcttgacaaggacaacaattccagttattgttcataaaaattgggttgctttattaagcaaagtcaatcacaataccaggaccgtgtgtacttgtcagcgtagtttgggacaatatgcttggttttttcgtttgttgattggtgatagattgtttgaaagccttctgtgttgccaacaagttctctagaacttccttgtcagtgaaatgggtcttggcaacacctaaactaatactgttaccacgttgtctgaatggaacagagctcatactatctttaatcaatggctcaagatcttcggcgacggttcccttcttggcagttggcagtaaaccacgaggacccaaaattctaccaacttgagaagcaagttgtggaacaatatctggagttgcaaaagccttgtcaaagtcgatactgacttcaccagccttgatttgacttactaaatctgaaccgccgactaaatgaacactgtatttatctttcatcaaagccgcttgtgcctcgtcattagtgaagacagcaactttcacatctttaagaggtttgccgaaggaaacattacctgtaagaggggggacacctctttctgctaccaccaatgtagttaacgtgatggtttgttggcttgctggttgcccgacttcgattgcacgtaagtatcttagtgctctagaaactggcatatacagtggatggtcactggccggagtttttgcttgcaatcttctttgaaccatttttcttagctccctctttctaagttgctctttagtcaacttagtacccgtttcttccgctagacggaaggacgttatctggaactgcctggtgaatattcttggaaacatcttgccgaccctattagcctctaagtagcgaaattggaaaaaatctcaggttattcagagacacaagtctttgaagtttttacgtgaaatagttgaaaattgattgtatcctctccaaagggtaatataacgtcaactcgttgttctcatcgttcttgttaacgcttccaagattttaatccaactaatcattatactaaagctgaaaaaattttgatacatcgacaaatccgggtaatatgtaattggtatactgtttatgtaggtgaataagacgaggaagaagatgagttatctatgatatacaaggccctggaaagaccacaaagagcagtttcacataatgcctatctgcataagtgtaccttacagcttcttcttttgttttggtttgactttattttcaaacgaaatccatttagtaggaataccgtagtcattcaaaatagagattacgattgaaccgtgtggaccctgaacctggacttcagcagttttcgtcgatttagactcaccaatggtggtggatccgctgcacttctttcttaatgcagcagctaattcttcagagtcaattttaaacttttcaaaattagtgactcttgtgatgaccttcctaccaattttcttctccgtgacaatttcaagagttgggatgggtcccttctctggtactttgagaagcggttcaccattaggcttgtagatttggtggtaggtgttgaagttttttgagaggaaagtgggcgaaactattagccctcttgcaattttctgtattccaccattttggggagctctgttagacatttgataaagcgtatcatcatatttgacaagagatttgttctccggatctattagattgttattggcgacatacaaatctagaagcttttttaactcttgttgagtgtagtaactctgtgggacatcggcggttattccggtaatgaatctttggcatgcgctcattggtttataaagattttcaccagaatatgctgttatcttgtttttatttgattggtttgtagtatcacctgaggatttcttagcaatagttgccaaggtcttgtaggcttccatgtttgttaaatccttatgattcttgtttagcgagataacggtgcaactgtcattcttgccctttagcttcaagaatccttcgtcttccaaatatttaaggagtttagttgccttcttccaggaagacttcttgatattcaccatattggtatcaacatcgggcaagttcttcattacatggttagaaatgaaggtagacgcgacaataggcaatgtgatcttgtcgtcaaatttaatagaatacttaactgcgcgcatcaacatgtgatcgacgtcttcaatgctcatttcttctagctcatctgcaatttcattcacaggtgactgactgctgcttctttctaagtgattgctctcctcatcaagctgttcaccatatttgctagtctgtgtttctattgctgttgtttcaatgggttcgctgttatacacgacagctggtggttccaattccaacttgaaagctttgaataatccatcatcaaggtaatgaacaaccctcacggcaataccttttgttccaataacgtgtgatattccgcagagatccatttctgcgataccaatagcttttactaataatgggtcctttgtagatgcaatcccaacaattgagcctcttttcacgtttgaaggaaatggaggaactgtgccaggtaacatcaattgggcacctcctaggatgtgtttttcaatgacaaagtcatgagttaagatgatcggaagtaactgcatttgaagattccataatgagaagatagtaggatacaattgatcctcaaactttgttttaaaccagattggcttattactctcatcggtgtaaatggagccagcaacatttgctacttgaaaactcgtttgtttgataacagctgttggcaaattgtattcctcattaatctgtcttttaatggtcgattgtaacttcttgcggtcactgtttttgagattcgacaaaggcttaatatgaggctctttggcaaacatagtcaaatattcggtctcttgggttgctgccaccgtcactaacgaattatgggcttgcttctattctttttctatatgcaattaaactgttcttattgttaagaatagtttctgaaccttaaactgtacatttactttttttaagagttagagatgtataaacagtaatattatacaataatatagtggaattctgaaataaagctacaaatatcacattaataaatagaagcacgagaatatagtaccttttctttcggctctcacaatttaggatcaagaatgtccttcagcatagattcggaactattactacagaaatacgcttgtggatattctgctactgtttccgatgaccaatctttggtctgtttgtggaatgtgcataacaatattgaaatatacagaacaaacggcggttatttgataaatagactcaatgatgagatacagaatcacagactgatagatgtcgtatggcacggtaatgatctcttttgttgttataatagcggcacggtttctatttacagagaaggacgcgaacttgtgaaacaattgacgtttatacccaagggcgctaagacaaaatgtatattatgtgataatttggttcctagtgatgaccgctattccttaagtgatgggaatctattgaactctatgccaaaattgaataaatgggacatgattaaaaatgagctcgacaatgagctgatcttaaacagtgaattagggaagaagaaacccattgatatttttatggcaattgattcaaaaaccaacaagttgattttgtctatcgagggtacccttaatatcaaagtaggtgaaaagttaaaacttccgaaagatatcaagaggatcatcaaagtgtcatcaggcaaatatatgtgtcttggtaaagattggagttatcaggtgttagacctaacattcctacaagatccgaatatttacaaattgatcaagacaacacaggagtatagtgccctcctccgatatttaaaacagttgcacagacacctgagaatgaagctaacggagccttacttcgagtttgttgaaacattgttaaaggaagaacacaagaacgcattacaagaattgttttatataggagtaacaaagttggaagtcatggaagaattgcatgaagttcaattgcagacgttcagattagataaatggagtgcactttctaatgatctatgttccaatagcatcggtctaatggtagcatgtacgataccactattagagagaatgatagttttagcagctagcattgaggcattgtgtgaagctataacctggatcaaatttcctaacgaaatctgggtcggcagtaaattacgagaacgaaccgtcgaaacgctgaaatcagtcagatctcaaaccgactccataatgaagaacaaaaaaactcaagaattgggattgatgtggatacggtccctgagcgatagtctttcaaagatggaaagaaacagggatcaaatatccccccctgaaccagaaacgaccaacggcagtaataatttctcatttttcggttctagcactggaatcactggcgaagactccaagactctccaaaagcgagcagacattaacactgtggaaaaattccttgccaaggatctactaccagaaaagcagtacgaatgggtcaagacaagcttccctaacttgattcttgaaacacaggccgagttcgataagataataaaagactatacattgaaatggctgaaaagacaaatgtctgtcgaatttgaccaaacaagaaacatccaaactggagacaatgtcgatcagatctgtgatattcgaattctacgccatgaagattcttcaaaacgggcgttattagtaacacctactgaattgattctattaaatttgcagacacagaaaattgatgtccgttcaccacttccattgccatcgcataaggtggcaatgacccttacaagacacaacactgatccagccgctctaccactcaaaaaacagcagtacaagaatccaagacttcaattggtccctatatctgctggacagccatctctatctactgcaccggtccaaaatatcacagaagaggttttctttctattgccgttatgccaaacagtcacagttttcattgagacagccgtcgcttctaatacagactcaattctgagcccagacggtcgctctcattccttggccgtggatcatcttccacattccgctgatctgacaggagaatcacatgacttgcatcggcacacaattcgaatagtttaggttcatctgaaaaccagaaaaccaagaaaaatgcacgtggttttgtactggtaattccaggaaaagcatgaaagcgcaacagccaccgtttatttctttttgttttgttatggctcgagtaaggcgccacgctagaatagcttgtaatgctgttctttactacgacgccacaagcgtgaaagaatagaaaaaaaggcagctatgttctcgcttagtaaaagatgaaataccgaattgatctaactcagtatccactacgtgttctagagggagaacagaaatggtcgttgaaagtgactttaatcacttctgcctttcagagggtttaggcatcttgagagcatagcatacacagctgtgataagtgtgtgcaatgcaacgagaatgagctatggaatcaatacaggtcacgaggagttatcagggtttcactactatgttttcacctctgtgactactgtgaacgttgaaatatgccatactgcttcctcagttttttttttcctaacagttttgtattaccaatgtcttttgaatcacacttgctctcgggaagaagtagggttgggtgataatgattagtactacctcaaattaccggacgaaactctggtaattctattgcaaatatgagtagcaaaggtcaaaacgaagaaaactgggcacacatccatgatcgaagccaggctgattcaataaatataaaaacatgagggttttgagtcttgaatctgtatctgaagctgttgcaaaacattattctacaatatggccataagtataaaagctcataattggtctaaatctattagctatatatatccaagataatcttatatctaggacatccaacaaggaaagatgacgtctcctcagcagacttctgtcagtggaaaagagtttgatagtttggatggagaaagcagcaatcaatactcagtaggtcctgattttgatcagttggaacaagaatatgacgatttgaagactagtgaaattattgcaccacatattagtaatgggcacagtataagctcttcaccaagacatcatcatttgtatgaagacagacatttagattctatcatcgataccaacacgcatggtttcaagaaacatgataatgggaacggcaagtttgcagatgtcaacatagaacagatttacaattatgattcattacgagttcctaactatgaggaaactgttgtagatgcaaaacaactatacgatgaaaaactaaggccatatttgaccttcagtgcaatagtagaatatttgacgtctttattcccattgttgaaatgggttcatcattataactttaactggctatacaatgacttggttgctggtattaccgtcggttgtgtgcttgtgccacagtctatgtcatacgctcaaattgccactttgcccgcccagtacgggttgtattcttcatttgtcggtgctttcatatactcctttttcgctacaagtaaggacgtctgtattggtcctgtcgccgttatgtcattggaaactgctaaggttattgcaagagtgttggaaaaagtcggtgaagataatcctgaaattactgcaccaattatcgctaccacattgtctttaatttgtggtggtgtcgcactaggtgttggtttgctaaggcttggtttcctagttgaatttatctccttgaacgccgtcgctggtttcatgactggttctgctatcaacatcatgtctggccaggttccaggtttgatgggatacagtaagaatgttaacacaagagactccacctacaaagttattatcaatacattgaagcatttaccggataccaaacttgatgcagtgtttgggctaatcccacttttcattctatattcttggaaatatttctgtggcacattaggtcctaaattggttgatcgttacgttgcaagatctgacgtaaagagagcagccgcttacaaatatattttgttttatttgcaagcccttaggaacgcatttgttattatcattttcaccttaatctcctggggtatcacaagacacaaggccaaagaagacttacctatctctttgttgggaactgttccatctggtttgaagaatgttggtgttatgaaattgcctgatggattggtttctaatttggcttccgaattaccatctgcaattattattttggttcttgaacatattgctatttccaaggcgttcggtagagtgaatggatacaaggtggtaccagaccaagaattaattgctatcggtgtcactaatttaatctctactttctttaacgcataccctgccactggttcattctccagaagtgcgttgaaagctaaatgtaacgttaaaaccccattatccgggatatttactggtgcttgtgttttattgtcgttgtattgcttgactgatgcattttatttcattccaaaggctgctctatctgctattatcattcatgctgtgagtgacttggttgcttcttataaaactacctggaatttctggttgatgaacccgctagatttcgtttgtttcattgttactgtcattattacaattttctcctcaattgaaaatggtatctactttgctgtttgctggtcatgtgcattactactattgaaggttgtgttcccaacaggtcaattcttgggttatgttgaaatttgtcaagttagtaacgctgaagttgatgaaaacatcgatcgcatcgtactctctgaagattctcagcctaagactatcgaagataacgttaccaaaaacaacactgcggtaaaagttggagtcgtagcgaatgagtctttcggccattctcaattacaatatcatactaaatggctaccactgaataaccactatcagcgtgaattaaatccagatgttgtagtacaagcacctcctcctggtgtgattgtatacagaccaagtgaatcatggacatatgttaactgttctagacagtacgataccattttcgacagagtaaaagaactgacaagaccaggaaagcttttgaaacatgtaagcaaacatgataagatgtggaatgatccaggtgagtgggaacctccatttttagtgaaaaagctatttaagttggggaacaaacatgatcttgaaggtggcgaagtaattgatgagagacctgttttgaagatccttgctatggactggtcccaagtgactcagattgattccacgggtgttcaaaacttggtcgacttaagaaaggccattaacaaatatgctaatagacaggtagaattccatttcagtggaatcatctcgccttggatcaagagatctttaatcaatgctggattcggtactgtcaatgaggaattcagcgatgaatcaatcatcgtaggacatacaagttatagtttggtcaagaatagacctgatttgcaagatccagaagcggcgttacctgaaccaatagcacttcataccgctttaggtgtaaacttaccattcttccatttggaaatgccagaatttcataaatggcacctatgaaaggtgtagcattactatttcgcatacttcttcttcttcagtatatatattcatatatacttaactacttctaatttaatttactgagtaatgacgcggtcaggcactacaataaaattgacactatgccatcaactacaatatattgaaatcgcgacggaaatcacgtgtacataactcaaattgtttagtcgatacgacgttccccttatttattcaaagtcacagagaatgaatgttgagaatatttttatgatcaagagcactcacctatggcaacaaaaagcggccggtttcacttctgactaatagaatgcaaaattcagactttgatccgtgggtgttatcagtggattagttactggattaataatacaaagaatcgtataaatggaagacgtagagataaacgaaaaaaggtaaataaattcagtagagacaccatccaacttccattcggaagtatatataggtagcatttccataagtattgtttaagtccaacattgaaacccaattaaaaaaggttcagcaaattcgagaagcaaagactgtagaacatcaagatgtcattgttgaagcaagtaagattaggacgttcagggttgaagatctcacccattctgattggttgtatgagttatggatctaaagattgggctgcatgggttgaagatgacaaggaaaagatcttttctactttgaaatactgttacgatcatgggttacgtacatttgacacggcagacttctacagcaatggattaagtgagaaattggtcggtgaattcttgaagaagtacaacatccgtagagagaccgttgtaatcttgacgaaagtgtacttcccggttgatgaagatctcgaattgagccacagcaatggatttacggaaaacgatcttttggatttgacaaaccaacaaggtttgtctcggaagcatatccttgctggagttactgcaagttgtaaaaggttggatacgtgcattgatgtgttacaaattcacagacttgatcgtgagacaccaatggaggaaatcatgagatcattgaaccatgtcgttgaatcgggacaagttcggtacattggcgcttcaacaatgctagctacggaattcgttgaattgcaatctattgcagaaaggtacggctggcacaagttcatcagttcccagtcctgctacaacttactttacagggaagatgaaagggaacttattccatatttgaagagacatggtgtcggaatgatcccatggtctccaaatgccagaggaattctttgcaggccagtaagccaacaatcgaattctaaacggtatgagaccgatggtagaattaagggcagacaattggatcaattacaacctcaggaaacagaaatcgtcaatagagtggaagacttggccaagaagcatggtgtcagtatggccgtagtatcatcggcatgggtcctagccaaaggtggttatcccattgtcggtctaagttccattgaccgtgtgaaagaaattatctccgctaccgaattgaaactctccgaagaagaaatacagtacttggaacaaccgtacctaccaaaaccgcttatcttgtaaatcatacgtggaatacaatagatagggtaaataagtacatgaatacatgaatagaggtatcacgtagatcaggtgttcactacgctggtatcggtcattttattttagcaccgatagaaatctggaagtccccagtcactatagtgaatactaaaagaaaaaaaaaagaatcatcagactcgagaaaactgcacggctggtcctctgagcgaataagttcccaagaaatgtgcaccagggagtcggacaacagtattgtaaaaatgaagagatgctgctgaatagtagaagcatctaccagcatctacaagtgtctacaagtgccttcaatgtagaatcttatgattatcctaagtacatccgatatactttatacttccgttgtagaaaagaacagagaaccctgaacaaggaatcacgggggaaacaggcacaacatacttgatggttccgtttccgaatgaaagcaaccccccataggaacctgatatccccacctctttagatttttccttaccttttttgtgccttgctcttttctctcgccatttgacacagatgtggtgatactttttttatcgaacatttttttttagtatggaagtggtgttatttactgtcggcatgattaaactggcacagtagggggaacatgtcaatttccatcgaaggtaggtgaaattgctcaatatctttcgatttagtggttcgatagttttgtgggtttccatttggtggacacttgaaacacttggagctatttagtatataagagatggacattcccttgtaaacggacatcttattgtgtcaatttcctattgtgtataagttaaagtgtcataccacacaaaccaaaccaaaacaaggaaattaaccaaaccaaatcaaataatacacaatgttcttcactaaagctctaagatctactgctactattgctatgaaccatgccactcagaccactaccaagactgctgttagatctgggagaagagtcggagaagcttgggctgtcactgaagccagaagattgggaccaaccattctaatgtacggtaccttcatcgtttctgtgttaggctggccattccttgtcagaaaggctgatatggatattggaatccacgggatgaagcaataaatattgtgatgaaagttttcaaaacctcatcagagatacaaatattatattgcattggcagtggctcatatataaacggtttaccaacttcaagatgagctaatatgtcaaccttattatcacctatattcttcgcaattccatgctatccatgaaaatgtacaataagcaaagaaagaaaaaataaattcaagaactacctcaacagttaattccactactttacactatcaaattgcgctacagatatgtaaatacagatatgtaaattaataatgatttaaatgacattcagaaaacctacctcacgttccgtactaaccttctttacagtcttttgtttgctctcaccattttttgatgcgtttttttacaagctgcgtcagtttgcttaggtaatccagaaattggcaattctcgtacaccgcatacttaatgcatgttatgtcgagggtggagaggatgcaggggcagcctcacaaccagagtgagacttattcagaaagactgaaccacataattggctgtcagtattaagtaatattatgtgtcaactttactaagattgggggatatcggtcttctatttgtggatcgtcctttaccccagcactatccctctttgaactgctcgctgcttctcaacgttcttccggctaatagcaagtaccgcagtacatagggatgttatgctttggaatctttaaaatatcttactgtagctttaggggaaattttgggttagggcatggccgatgtatgggttaactcagtgaataagggaggagaagcctcatcatttgcacgaggtggcatgtttttaaaaattaagcaagtgccatcatatatcatctctccaatcttatcactatataagtagttcagttccagctggcgttctttgtttcctttagcagctttacccgacatttcgtaaaaccaattctgacactatcaacaagcttcccagcagagcaatcaattactcatcaaaatgtttattagactactacgagctggaaaagagcacgcaacaacagctagaagagttgtatatgcttcgggacaccatgtcggtgaatcgtggacgaaatcagaaacaaggagattggctccaaatttgatcacttatgcgttgttcattggaacaatggtcacttggccttattgggtcaaagaatattcttatgtaacgcatggtaagccaaactggtcgccataatctgttaagacgaaggctgtatgaatttctcattccttcgtcaaacaaaatactgcatttgctatggtaaaaaccctttaattttccaatactgactctactagtttgctatgttgcatggagttaaaatccgtttgcgttcaatactgatacccttcgcgctcaagactttttttttcctttctcttaaaagtcattatacctctttattagttatctggcacctcatacttagctagctcatctttgttatctatttatactatcaataaaatttaactggcaagcattacttagcggatatcattagtttttattaaaatgaaagcattgatatttaatttatcttattatttttgatgaggttaagttttcaaatatattctttatctactgtggtctagcctttggtccccagtttttggtaggattttcttggtatcttacaatttttagcttccttagcttttcaaacctaccactgtattcattaggttcgaaggatatctttttatcccagtcttcagtttgtccgatggtatcattggtcaaaatcttgtacccgtttccattcttattcatcttctctatattgacaagattgttatctatgcaatacttcttcatcacataccaaatggcatcccagctggcatcggtcttcaaacttgatgcctttgcatgtgtcaaagaacattcaaaccctagcgatcctagtcctgcgacaactgcctttaaagttggcacttggaatttcaagactgaggacaccgagtttggtgtgaaatagaaaggagcagctatctcattcttggctaaagtcaacataccttcgattctctttctcgtaccataaatatcatccttatgttcttctttattaattctcaatacacgatcaatgaattttttgttatgcaatggaccgccgtacattggcccaacgatgtgatggacgctcccgcagtatgaacaattcctatcaactggtggaccttgtgccaaggagaatttggtgaatttgacccccttcttagttgtcctttcttgttgtctgcctagaggctgtgtgtggtaagcattacagccagaacacatatatccgaccatggtattcgactgcaagtttttgacttcaattgggcttgttttgactctaatgaaaactctgacgtagaaatcgatacttaacgaaagaagtggttcaatagtctttttatactttgcagctgattgtcctaaaaggtttaaaactagcctcaatgcactttcatgagtagcatcgtgacctgccatattaacaccactgtacaatgcaaaacatttttcggggtatccgttaccagccaagaccgatagatctgtacatgtaaccagcatcaatccaccatcttcgatggattgcattgatgcatcgacgaaaggagtaacggtaccatatggatccaaatcaattacatggtatttctcatttttgcttttgtttctgtacatcagcacatttgcatcatccaaattgggtacaactttatccgagacctcattatagatgacatttctctttatggattccactgcctctggtagtaaatcgttggctacaatagtcttcacattaggaacctccttagaatatcttatagcacgtagcccggttgcactcaatgcttccaaaattttgatgtacggcctggtagaatgatcttttgaagacacagctacagagtcttgatcttcgtttaatttacgccttttgatagtatcgtaatcggaaccatcttcattgctctctatgggtttccttttcttgttcttgctcttcagttcacggctttcacgttgttcctcttgatacagttcatcccatgctttgatacaagtgacactcaaatctctattgaactgctggattggattatagaacacagtttccttgttaggaaataatatcttagcatcaccctcttgcaccaccttgaactgagaaacatcgatcgttgagctatccaacgttacttttctgccaaattttgacttcaaactttgaaaggcagccctgagcatattgcaagtttaaattcttacttttctttatatggttttgctttccctcctaaaacaaaccagctgaaaacgcttacttggcctttgacacacacctcagcgattatttactaggcctgaggatcaagctatatatcttatcttaagttgatttctgcgagaagagatgtgatgagatgcgatgcccatgactgaaaaaattgaaaagttggaaactaggctgtaaagatgtaaaaagtatgggaatctatgtcacgtgatttaatctttctattgtttatttggcacgtacgattaagtacctcaagacgaaatgcatatggtacacatggttcagtatcgatattaatcgaggatatgatgactagttcgaagcagactattagctgttactacttctatctacttttttttagctttcattactgttctcttggtggaagtaatatcattatgcttatagtgaaatttgtgcgtttgcattaagatttattaccactaatgattcaagaaaataagaaccatcaaatgaaagaattcacaaaactctaagaggcaaacaagcgcgggtatgccaccaaaaggttggagaaaggattctgaaggaaattatcctaatacgtcttatataaaagaacaagaaaagatcagtattgatgatttactatttcctaaaagcataatcacatctctagcgaaggaatcacttcagaacgcgtttcaaaagggcgaagaagagagaagaatcacggttagtaaggatgctgcattggcaatgcagaggtcagcgacagtctttgtcaatcacttattaatgtttgctagaatgaacgcaaaggattctaatagaaagagttgtaatgatcaggatatcatggctgctttagatacgttggggctaggtgctttggagagcatactcacgggaaagatgcaggagtaccaggaagccatactttggaagaagcaaaataaagtcaataatgctgtgcctggtgcggacggagacatagcaatggaagatgatgaagatgatgaagatgacgatggcagagaaggcgcagatgctgacgccgagcctaaatccagagctgatactgaggttcaacaaggtaacgctgaaaatgataaattagatgggcctccagtcaaccaagaacaagtacctagcacgcgccagaacgacctggatttaagcacaaaaaaacagaagacggaatgatcgtataatcgatttgtggagaagaggtggcaagaagtataagtactataaacaattataccgttttcgtgtgctcatgggttacctatacttaaaaaaaatagaactaatgtagtaataataacgacacaatcacaataatcgccagtacaactataatgacaatggaataaaacttaacgttattccaccacatttttctcataatcttagaggatttcctttgaaatttaaaactattttcgttcaattgattagtattatccacaagcagggatatcctttcctgtctctgtaaaaacttatcgatattatcattcattattgcaataatgttttgtagctcttcctcagtggatgcagctgtctgctgtccttccgtgcgataagataataattcttcatggaatttgtccaattgattatcgatattactcttcaaatattcatcgttgtcattattcaaacattttagttctgataataacctcaacggtaggaatttggggacttcttctttaacaaaacaaatgagcactttattgttctctgcagttgtataatagcaatcatacccctctataaggtcgatagacgtctttgtaactttgtttcccggaagattcaccactgttcgtattaccatatcgccgattaacctgtgaaacactgctttttgatcggctctccctttatcagtgcttccatatttactattgttttcgtccttggagtcgtaccagctagaaagaactcgatctccatcccaaacttcaacatatgacacactataccgcttcattgttgtaataattcaccactactaacaggcaattaatcctgagagtcctttcacagtttccttgcaacccttctaccagatgtagctggtaaacatggaaatttgtcagttttcatattttcaacattctccaaaggatatcataacagaatcagaaccgagacaaaatctctacctccggcagaaagaagaaaaaatgtcagctgaagcctacggtatagttgtgataacttaatagtcttctcatttttgattgaagctgctgatacctaattcacttttgaagtacagaattattcatatttatatctatttgacatgtctataaatctatcaaagataatgtcgataatgacatattccaatgacaaatatgtatgcgtaagttcctttgtgatattagtataattgaactatacttaccctcgataacttatggtacaaaggttggaatttgtacgcaggacttagaatcttctggccatttgagatacccactttccaaaagttcatccagagttttggcctttgtaccggtagctttgtaataagcgacatatccttcttttatagcgttgatggctgacctagctctaatctgatctcctttccattcaacaccaaaataaccaccattaccagcatgtctaatctcacgatttaatcgttgagagtattggacgtcccatgggaatgccaaatcatgatacttacttccatcgccacttttctcgatgaaccaatcatggtacttctgttgaagttcctccgatggaagttggattcttcctgaccatactctgctcaaccaagcaccttgggtctcggatagtcttgtaggaagaacaaaccttggtaggccaataataccgaatgttggcaatgatattggaagaatatggttgtacaggttttgtactcgtctaccatcaccaattaagttgttgagaatggaatttccgacaccagattcattctgtggtaaaaatggtagggactttaagtaaccagtacagaaaatcactttttccacattctttaattcggtgccgtcaacgaaggtaatcgattttgttgacggattaaactctctaatatcaggcacatctttaatgaaaggatcgaatggggccggtaatttggattcggatctcttcgacttataaataggcttctgtagttcgttagccaattcaaatgctaagtctgcaccagaagcactgttaccaacaatcaaaatctccccttctacaccatggaaatcttctggacagtcaaaatccttggcatgggaaacggagcatgggtatttcacgttccattcttttaaacctggtcttgaaggaataaatggtagatcataaaatccagtagcaacggcaacggcatcgaacttctcctctgtaatttccttactgagaaggttctgagctttgacagaatattcagctgttgcgtcttcgtaagaaactttcacaatttctgagttgaaagtaacatatttttcaatgggtttggaatatttcataatataatcaagcacttgttctctcacagggaataatggggtgtctgttggaaatctgtgacctttgtactccatcaatgtcttaggaacattggtatctagatatttataaactgctgtttggaacacatgtgtttcttcagggtgtggttgaggttgaattctaatgtgagggtattcacaaggaacagacggcgacgatgtgacattagagtccttcagtaaaggttttgtatagttccatagaccaccaaaattggatctcttctcaaaaactttgacagattcgaaatgtttctcattcagcaaggcttttgttaaacctgatccaactggaccagctccgatgactgcaacgcggcgaattttatcaggattcacttttattaatctaatttgagtaggtctcattttttatagtgattgcgcgccctcgtaacagactttcgtaaatccagtgttaatctttggaaggttgacaatttctcagctgcctggtcagaaattgtatttaattggcttgtagcctatgtattgtaagtgccactttttttaaaactggatactgcgatctgaaaggatgagtttggcagttaattataatgttaggaaactttcgaaatctgtctccgatatatcgatataggggagttccttgattgaagctgctagatttatctcatcccaatctcttgttatatacgtttatgctctttagaccatcatgttttttcattcgatgaacggactttggctgaatcaagtagtttaaaaatccgttgtggctttatcacgtgactaaaatcactgcatatagacaccgtgaaccaactcactgctagaactgtgtggggtgtgtgttgaagctttagaagatggtgttatctgatcaatatctagatgagatcttagagatactgtagttatcatgtgatggtttttgtggacatgagggacctactgtgtcttattaatccataaaagatcgtaagttcctaatacattgggtactaaagtcatagcatcattattaattgataagttgctcgagtacatctcgaataggaaagtgaagtggtgggaagaataaatatctatgtctatatctatatatgcatatatggttgtataatggtatcggtgataggaaggtaaatgcttttttttgttgttttttttttgtttatctatgttgcatattatcagctcgagttcatgcaaatctacagtcacaccaacctttcaccacgtattgaatctccttggaattagcgttttttccaagggaaattctgccacatggtttgaacatagttggttgtgacatttctggttgtgaccaaggtttcacctcggagttcaatctcacgagtgacgtagtttcctttgtattttcatcttcttcgatatctgatgaagaagaatcacgtacagttgttgccttgacgaatttcaagtttgctggtgcatgctcaccgtgaagatctgtcctcgtaacctggcacatgtctgaccaaagcttctttcttgttattagtgctaatttgatttgatgtggtgatatcctgttggatggatctgctggaatgttcaactgagaaatttcttggattgaaagccgttgtagaatggactcatctaagttgaggtcaggcaataaatttttctgtttcatactagtttctaatgcatacagtcgtaaaaaggatggatttagcgtctgttggcgagttctcttttgcgttatgggatccaatgtgatggattccatgctattagtttgtagatgctgttgctgtgaagagttgggccagtgctccatctctacaacttgttcttgtaaaaagatcggtttgaatttcctgtgacgtttatgctcttgttctgagctttcatctgatgtattggtaaatattggatcgatatccatgcgtttgtttttgggtctttcgtagattggtgtaattggttgtagaatgtccttctctgaaaaagattctgtgaaatccaaatcgttcaaattatacatcttagtatgaggcaaaacttcatatccagtgctctgagggtcacttatcttctgcacgcgtcgttgcgatgtttccgtatcgctgtcgacatggctcaatggatggttccggtcagttactccatatagtgttttgtcatctttagaacctacatctgaaaacacattatctgcactcgtaccatagggactcgaatttgatgataatatgctccgtagcgaatccgttgaagatacggtggatcctgtatttctgcggtctttgcttcttttctttatctgacaaagaacacttgacaaagaaggggttagagatgatgcatcgggtgtagacgaaggagacaccgaaactggactagagaaggttctctggtttgaattaacctcatattcattgacattacccagcgccttgagatcttgtttcagcttgtgccttgaatattttgtcgtcggttcaaatattctagccttagattttatatgattcaatataggcattgggccaggattcgtcatcgtgttcagtactaacagccccatactctttactttctctaattgataagttttctttccgctgcctgctgcttgttttgatgacctctgctctaatccttcaaatacaaacacggaactgatttataaggttttagttatgtagccttttgtagcattaacctggtaggtgatgatatacgcgtcctggacagtaattaggatcccgtttacaccttcttatgttatatatccatcgtttcatataaataagcactctctaattatggaagatgccttcgggcaattgatgacggatggcagcttgactgaaaaagaaatcgctgttgtcagctttttcgggaatttaatgactttttaggaaagaccgcaattgttgaccggaaaagggatttgcagtcatgtgattgaaaatctcaaacggaatgtgcatcgcgattatagattgtaaatatatatatatatgtatatgctaatattacattttgcggcttactattgggatgcttgctgtatttgccatgaagccggttgaggtttgtgctgatctggtgtttgttgcgtagttggcgacgtactggaagttactgggggttgatttggtgtagtcgagggtgaggcagttgaaggtgattttgtcaactccagttgccttttcttctcttccttgattctgcgacgtttttccttttcctctgccttctttctttcattggttcttattagtttcacatcggcagcaaaattttgtcttagttcagattccatctcatgtaaacatcttgacgagataaagggttccatgacatcgaaaggtttcctctccgtaggcctattctcgatgtaagatgccttgccgttaaccgattcgtcccttctcgaagatcttctacgaaggttctcgtcatacatcgttacccctccaagttctctgggtgttaacatgtggtcatgtccatgtgaaaggatggctattactgatgggtcctgctcctcccaaagttcccatatatggcttttttcacaacatactatcttttggtccttcactttcttgaaatcgttaataccgtgttttccactcttgcaatccaaataccaatcctgagaatcgacttgatagttgttcgttggaataccaaatttggacagactgtcaagatcctgttgtgtgatacaaacgtctgctggtaactctaatgtctccacgtctttgtaactatacgcactttcgtcgactggaataatccattgtttaaaacttctaccatacccaagcacatatgagtcgacttcttgtagaaactgctcgccatctatatctattgtgtcatccatgtttttcctctttagtctctcttgtctaaaatctttatcaaacttttcccatagtaaagaccataggtaatcctttaatttcttcgtacgtcttgttaagattctgttgcgatggcgtaagaattgttctctgcggtcaagcttgtcataccatttcgtttccgtctccttcttttgatgtccttcatcgcgggccactattctggaagatctctttcttctgaccattagagcttgcatagactgttgtttcaatctgttagcatacaatttacgtccgtaaacctctgcctctgcatggtattctattaagccttggaaaaattcttgaaaatcaatatcatctatcgtttgtagatattcgacgaagcttctataatcatgtgctaacgtttcataatcgatcttgacatcatttaaataggcgtcgatctcatcggaataatccaaatgaattacgtctatagtggcttctgtctcttcgacaagaacacaattctgtaactttataggtatgttcaatccgtttgattctggtttgaccgatacctgtttccttataatctttccagtgggtaagaccaccaaagaggtagcatcattctcccaaatctcagggaattggaagctatccaaatggttttgtaaatagttcctaaaaccaatgttctttctttctaccaatttaatgacatggaaaatgatctcgaactgttttaatatgttgagatccgcgaatttgctattgatatcctctgtgtaccaaagtagagatttgtttaatttcgaattaaaaatgtggtacttcactatttcatcccaatgtttcaaggataccgtcttatcctgttctaaagacctgatcaacctcaacaagatactcttgaataaattcagtatatgaccctcttcgtcctgatccgtgctgcccccatttggatcctccgattgaaccaaatccaacgaatcattttcgagactccatcccgcattataatctaagagcattattctttcatcaaacgtgatttcagtccaccaaggtttccccgtagtgaaacctagcgtccagtaaccagtacaaacgttatggaaccacatcacactgtactgataataccaggactggatcaattcctgcaacggtacaaaatccaacgcgattgggggcaacttatttaactggttcaagattgttcggtcgatatagtcatcccatttcacagccgttgtttcgtaatctgattctacgtcaccattgggaagggccgtctcttcagctttcgtctcgactttcgtactgatctcctgctcttgctttgcctcttgctctggctctggctctgccctgcgtctaagtctactacttctcttcatactagacactatatattttttcttttgaattccctttctgcagttgatttatagatcgtgtcgtatcgtattgaatcgtattgtttccctattctcacagtttttggtttcgatacacgactttcacctgcaattccaattcctcaattagaacactccagactactcccttttccacttgtacgaggatataaagattaaacttaaactcaatataaattctctacgttctaaaatcactactttgaaatcaacatcttaaacctgatatataatgtatgaagcttaaaggctgtttgcattttgaagcacaattcgaaatttgaaaatttgaaaaaaaaaaaaaatcgcgaaaccaaatataagtccgggtaatcgagttatctgccaatctttcattttcatttttaagttctcgcgcgttctttgctgtacttgacagttgacaatgcataatttacttgacatttacgtgaatagaggaggcttaaatgaatctttgacactgtatagatctataaacatcacttaacacttgtgctgaaagttctttgtgtatgccgtttacttccgctactcatgtcatctggcccgccgtcttatgagttaaatacacttttctgtggtcgtattatccccaatacacccacacatcacatactatactgcaggttttcttactctcttcgcctcgccctttttgcctccccttcttgtacgtaatattagaagcaaagatctcttccatctcggtgggaatttattacgaattaatacaggggaacaaaaaaacaaaaaattaaaagatatgattaaagaatactttagtacaagtaaacaaagcctggcctggtgaagatagcatcgttttgtccctgcttgtgagacattaatcgagcttgaagttaaagaatccattccattctttgtcggagttgacgttaggaaagcaagaaagaagtacagtgttttctactctcttttatttttttggtccatttcatatctctctctttctcttgttttctgggttgtcattggcctttggattgaattggggagtgacgaaacgatatttagaaccaatcttgaattgattactttcacagtacactagaagttgttttccccctttttctagggtttgttttattggtgccaattattttactttggtttcgtttaactcatagtttatatccacgatgccttcagctcaagattaccacgtaaatcctcatttccatatgggcgacagggagggtgaacatcagcagccgccaatggcacctgctacgcctcgtatgatgggtcgtcgagtctcagagagcagtgctccgggactcatgcccgctgctaacattgtgaatgataccacgcaacaaccgcagcagcaaccgcaactgcagactgtaccacagtctgtcccagtaccagcgcagagtttcaacgatgtggttagtaataaaccgttccataggaaatctttaggtgactgggattttttggaaacagtaggggcgggctcgatgggtaaagtgaagttggccaagcatagattaactaatgaggtatgcgccattaaaattgttaatagagctgcaaaatcgtatatgcataaacaaaatcaactacctccgccgaaaacagaagaagagttgatggaaagaaagaagaaacttgaaaaagaactttcaagggatagaagaacaattagagaagcatctttgggtcaaatcctataccacccacatatctgtcgtttatttgaaatgtgtaccatgagcaaccatttctacatgcttttcgagtatgtgtccggtggtcaacttttagattatatcattcaacatggttctttgagagaacgtcacgcgagaaaatttgttcgtggcattgcaagtgcattgcaatatttgcatctgaataatattgtgcatagagacttaaagatcgagaatattatgatctccaccagtggagaaattaagattatcgactttggattatctaacctttacgataacaagaaacagttacatacattttgcgggtcactctatttcgcagcaccagaactactaaaggcaaacccttacattggacccgaggttgatatttggtccttcggtgtggtgatatacgtattggtatgtggtaaagttccattcgatgacgaaaacgctagtgttttacacgagaagattaagaagggcaaagttgaatatccacaacatctttccattgaatgtatatcgttactttcaaagatgttggttgtagatccattgaaaagagcttctttgaaacaagtttgtaaccatcaatggatgcaaagagggtttgatttcccacccccttcgtatattccacatagagttcctttaacagttgaaatgcttgatgttaacgtaatcaaagaaatgcatcgtctagagttggttaatgatgttaacgatgctttacaggctctgcgtgacattattgactcacatgaatataaagaactgtcaagagaatattggtataacgtccaaaattccaataaccaggaagatggaaccagagcattccatcctttgctttctatttattatctagtcgacgaaatgctaaagaggaagctggccaaaagactacagaaacaacaacagctacaacaacagcaacagcaacaattacaggctggttatcaatccaaaccatttcaaggtcaatcgcagcccatatttccatctgaccaagtggacacttcaataccattacctgatcaatcgcagccaaaaactctacaacaacctgtgtctgttaacaatagtgattatattgttcgaccatcaagtatcaaggaagtatctccagaacataccacttctccggcagcgtacattccatccaatttagaaagaaattcgacagtagttgcctcaccagttaggaacaaagagctaccacagattatgatccctccaaaacttgccattccagagctagcgcatacttctcctactcgaaaatcaagcgatgcaaaccccgaactggacgcagtaatgtcaccatcgcctgccccaatggattatccatcccaacaagagcaaaccaaacaacaacaggctaacaagtacaacatgggctcggtaaaaacaagcactacaagcagtgagaagccaaagataggttctattttccgtagactttcacagcgccatcgccatgctcagaccataaaccagggctcgttacaagtgcaggagccgaaatcagtggcgttacaaacaaatgctgcgccaaaggtaaggaaaacgcatactcgtacagtatcagaacatgtaccgtctacatctcgttacgcagacccgtattactctgaaaatgctcctagagatatgcaaggggacttgccggcactaccagctaatgcagacgtattggtgaaacaacaacaagaaaggttgaatgacttgaagttgaataatgaattagatgatgaatctgagactcaatccactaaatatgacgaaaaccaaccacttgctcttttgtctctgcctaaaggaaagaaactccatccaagtgcaagggctaagtctgtggggcatgcacgtcgtgagtcattaaagtataatcgtcctcctgtattaacaacttctgctgccaatacttccagcgatggttcaactgcaccaggtcgtattaatactaacgatgatggcttcctgcaatcaagctcagaaggcaacgcactccagatagacgacatatcaccctgggaagaactaactgatgaacaaattattgaaagagcatccaaagctcctccaggttcaatgccatcgatcgacttcccacgttctttattcctaaaaggctttttctctgtccaaacaacatcttctaaaccattacctgtcgttagatacaagattattagtacgttgaaaaagttaaacatcgaatttacagaagtaaaaggcggttttatctgctgtcacagacaatcttacgtatctcaagagcagcctccaaaccacggtaggcatccttctattgttattaatgaaacttcttcattggaatcaaacagctcaacagcaaactcccatagaaaacaattgtcaataccatcacgtcatggttccattagaagacatggttcactcaaacaaccaggaatcccagccacacctctggctgctgcaacgcatgaacgaaatctgtctgtcacttcgccacgtactagtactgggcaaatcctagaggaagtttctactgcatccttcgaaactctgaataatcaagaggacatattgactaattcaaaggcacaagatatgaataaagttgttatcggcaataagaatgaagcaggtaataaagaaaggccacctttgaagtttgagatacatatcgttaaggtcaagcttgttggcttggctggtgtccatttcaagaaagtttctggtaatacatggatgtataaggaattggctacacatattttgaaggaattaaatttatagattaaaactgtatacacactatgtatgccataatcatttcctaatgcaagtctagtttataatgttacatgccacttttgtctcattatgtcattacatttttctctatgcaataactacgtgaggaaaccaaacgactattctaagaaactcatttacaaagttgttcaagctcctcattcgccagtaaaagcagctggatgtcctggacgatataatttaacagtgtatgtttcgtgattcttttcccttccttcttcgggagtttgtagtcaagggagatgatttcttttgatttcggcagattcttatgaacttcagtccaaactggtcgtggatatcgtatcatcccgatcaactcatcgtattctcttttgaaagtgtttcttctttgtttctctaaatagacatgtttccaccttcgcagctctgcagcatcgcttgagatatcttcaggaatgacgtgttcaggaacttcaacgataggaattttgggatcaattggcttgtactgttcatatgattcgaatattggaagaatcatgggttctatcgtagtagatttacctttactaccattgtcattttttagaatatccttggaatttacattattgtttttttcttcatgagatggggatgccgcaatggcaatctttgtgtccagcctttctccctgcttagtggttgacttatcctggaaatgtctggatattgtggtttgtagttcagtatggtcgaaaatataggtatgaggatcagctcccaaatgttccgcatttcgcataaaattttgagccagtttcggagagaaaagggcggcattagaagcctttgacggtgaggtagttaataaactatccaaaaagtgctcaattgcatgcgactcgttcacactcaacaaaccttcgttatgtgagtttccagagtgttcaccaaacgccccgaaaggtgatgaaatgtggtttcggggagtctgcggtctgctactaggaacagaatgggtgatttgtgatgcagctggctttgtgtctttttcttcttggaaagctctatctctattgactactttgtcaacttcctcatcagtattagtatgctgatcccctcctgtcgaagcattctctggaacaacagtcatatggttgaagaactgagaatcatctacaagattcatatgaaattgatcgtttgaatcatcccatagttccgctttctcattaattaactcataggcagtctcgaaatctaaaccttccaaatccatgtccaacagagaaccgaggccaccttggctttgagcttccattgtattttcagaaaatcggttaagatctgtattgctactgaacactccacgcgaatagttaaatgtctaaatgtttgcctgcgtccaaaatacccttttataattagatgggtactttataaatctatcaaacgcaacaaatctaggtatacttgtacctcgaatctccatgcactcatatatcaaactccgcagatctaatagtccagctaatagtcaacgctgtaataactcgatatagcaacttatatcactcaatggctatatgtttttctgcaacgcacctccaataattcattcacattacattgttggaccttactataaactaagatgtactctgtgatgttttccggtaatcgagcttttcgtcagtttctattgaaatccggacgctctggacattttcacatggagaggatttaaagtcacgtgtaagaagatatcacgtgaacgggcttttctcgtatatcgtctatcacttagcatcgcgcgagctacaagtatccactcattagtcgtgatggaagtacagctctctggctgttatagtaatcaaatatgacagccctgatctagcagtcacggtatgacttcgccttcgagaaatgaaatggtttttctttgctcaatgagaactgcattgttgtgccgtcttgcctcgttgcagaagaagcaatccatttcaacttgctgaacttcttgtgacctctgtttgagattttcaagatctcgttaaattcaagcccatcttttcttctattcctcttgattgtcaactgatcaaggccgtcgtctaatgacagggaccacgaacatatatctgagtcttttctttcagaacatctttctaaagagaaaccaggtaccactatatttggttcgtcagtagtcaataatctaatgcatcttccatctggatagaatctgaagtacctgtaataagtgatcatgtggattgggttcaacagcgaagatgatccttccgggatcgatccgtgcctcaaataattcaccacactgatatatattccatggaacttgatatacggccgttcctttagcatctttctataattttgaccccatacggtttctgctagtgcttgtatatctgatataccgtttagcctcatctcattttcgttgtatacttgcttcttatagatgtattccgcgaaagtccggtacggtgaggaatcgtggaagcatagcaaattaaactttttacaagtcaaagataggttcatccacgagtctgctgagcttaacacaaccatgtctataatcatggataatatatcgtcagggagcatatccaaaatccagcagggaagttcaacaaggtcttcagtttgagaaagtccttcagtttcctcttttctgccgtccggatcagtttccgatgaaccatcaacaatattgacattagaattgagcttaagctttttcatctcttcatttaaccgccattcatcatgcatcttctttctatatagtttctcaacgtccggattcatccttaatgctttacggtaatatttgatcgcgtcggtcatagcaccggcagtttccttcgaatagcccaactcccatagtgctatagcttcaatcggttcctccattacgcgttgttatttttcgtgcgttaggccccttggtaatgagtatgcttcctctctcttttaccttatatagccgactagctttttatgctgtttacgttttgttcagctttacgcaacaggaacgaatataaagttactaccgagagatggacaagtacgcacaatgttgaaaaatatgaagtggattccttgtcagtagctgccatcctcagcaaatcggatttcttgattcttatctgactaaaaagtaatattaagtacatggcatatttaatatatgaagagctatataacttcaaagttcattaatatgtgaatatcacaagaaacacagtcgataaatcataaatagccagtccttcaagatctggtgcatcaatgaaaagcaggaactaaaacaaagtgcaaagtgtgtagtgctgtatagatgctgcttatttcattgttatgtcaccaccgattaatttatcgatttcattcaataaagtaaaatcaaaattatattcaaaggcaaattcattaccattagataaacttcccaagagtgcagtgttttcaagtccagtattagcatttatattgctactttttgacattttcatttcattatcgtaaaatttcttggctagctcgtagttcaatgacggagatcctagaaattccaagaatatcgaaagattgtccttcttaattgaaccagtttttatgcactgaattgcaagaatcgaagaatacagcatataaatgttacttttctggaatgttttgaattttctcataaacgatcttaataaaaagtacaactcttcaattgcgttttctatcgcctgtttactctcaggaagtgaatcaataaacggtttgttgtaggacaaaaggataacaaaataatgataccatacatgagccaaaataggattgtaatcgaagttgattagcgttgccttagtgagagcaaactcatcaggtagattcttacgccagtttgaaacttcactgttgaattttgttagatattcccttctttccgttaaagaaccggcatgtatgaatatcttcggggcgaaaacctcagttattcttgatagcacaataatcttttttaaaggtttggcaatagaagttacaattgtaggatcgtattggtaatcttcgataccagtatcaatatttggtagctcatcagtttctggaattgtcgaatttgacacacgcaaagaatttgaacgaccaaacaatactgcaatcaagtgatcggcaatgtaacagccccagtatattctacttctcacctcgatatcgatctgtgacaatttgtcgtcgtagacgtcatcccaagcttcggggttcaaatgtaagccaatctcatgagccattctaaaggctaaccccgattcataccatgctaatggattctcgccatttccaatatcatagaaggcaaggcataaaagtgtttggatgatacccaatttagaagatgatgaataactcgcagtagatccatctagctggaagattttatttaatacttttgttttagccagtgtgtaatattcttgagatttcttgtacagttcttcgttcttatcggcaagcttacttcctaaagcagcaattgcaaacaccaattctttagaacagtagtatgcttttgtagaaggctcaccgaaaagggcgcttagaaaggtttctctatgaatgaaagtataatggccaggatataaccatttgaaaaacaacgataaagcaggtagtatcactggcgacctggacaatgttcggagattagaggtagtcatatctcgattgacatcgttggaaaatatttttgtgatggctagagaatcgttagaatagatactggatgaaaccacttggttatttttggtcaatgtactttgcatatttggtgatgaaggagtaggcgatctaatctcagcaaggaagggcttccatgatgggtttcttggtggaagtgtatttgatggcgtcccttctaacgtttcgctcttcatcttctcgatgctcctcttcaaatcatcaatctctgcctcaagtttctctacgtattcatgagttgttcttttagtccgtttatcattgttgacagtgatacattcgatcccatatttcaagcaattggaacatggtctctccatgtcacacttcctcctctttattctgcaattctgacatgctaggtgagctttcctcttcctttttccatcagttatcgttgacattgaataaacgcagctatgttgttgacggtggtaatgtttattgtagttccgaaaaaggtgccctatatcaaaaggtacgacggttgcgcttcctttcaatcctgtagaagtaatgccatttatttgggtgaccgattccttatgatacactttggtaaacttatgtcttatacatcattactctttcatatctccaaattggccaaagatatttcttatttgacactcaattcctttcttctgttgatgttgggagatgttcgaaaggaaactgacgctggggaggacagttttgtatcaaactgtacatcagtagatgtgtacctagtatgataagtagaaatggttgttattgtatatgtacatgattacaactatgctataagacaggagggggtgggaacgagcttgaaggtgatatatgcacaatgaatgattacagattttaatcccttagaaagtcgaccaatttggagttgaactctgatgggttatccaaaaccaaattgtgaccagctctactcacgatatcgaaagttccatcgtagctttttcttatactattgaactcctctatcgccagccttccagcgactttattcatccaatcgtgttcaccataaaccaacatcaattttgacactttaactttatccaaagaatccatgatcggatcatatgctaacaggcttcttgagaatagttggttgaatattctgatagaggtatcagtcataattcccttaccgaaaaccaattgaaacacgtactccctgtaagggacgcttggaactctaccataagagctattcacataaccccaacaagctttggctcccaggggacccatccatcttagagctttattttggtattgtaagataagttttggtatatttcttttattcgagtagttcgatttgctagggtcttcggattgtatttcataatctctttccggttccaaatggttatggatagaaaatatgcttctttccacaccaagtggtgacacaagacatagtttatggacgttatctgggtatttcaaagagtatttgaaagttagatagccaccgtacgagtggccaaccaaattaatcttggacaatttgttttcctttctccatttttccaaggcatcgacgtaatagtcctcataatgagccaaatgtttcttatatttctcttcatcaaccggattctgcaaacggaaatactgacccttcacagtttcgttgaactctactctgtcaggtttttgcatagagtctactgagagaggtaactctttcgacaacccgttcccgggcaaatctacagcgtagacatctttcaaggacaacgaaagctgctcgaaattcctgaaaaatgtcattgacgatgcagcatacccatggatcatcaaagtaggtacccccactgcttttgccgtaggattcgagatccgccattggttgatctcgcccaatagcatcgaattttcgacagatatcccggaatcaaactgcaattggtccataagattctgttgcaaatgcttcaaactaccctttgcatcgtaatttaaactattccaccactgtttccagccagaacgcttcaaagagagctcgtctggttgcgacattcctttcctcaacagcctcaatgccaagcttctgcgaactgtcatatacttctcatatacttcccctcgaatgtttcaccactgaagtctattcaaaaacgtaaactgtcacaaatgtctgaacttatatggcaagcaagaaaccttcaaagttgccggataaaccaccccgtgaacagctaacggtgctactgtgtttacctgaggcataagtgcatacattcagtacgtaaacttttaaagcttcacggacatttgtcagcttaaagcctcgagagatataaagatacccgatggaaatacgatggttgatattttgaaaagaaatcaaaaatcaacatacgcacatgcacacacgtacacactcatcccgaggagaagaggtgggattcgtgtcgtcctgggctatgagttttaaggtattcagtgagaatacaaagtagtgaagaatactagtaggtctctacggttattttaaaattaatctaatttattataaaccgtaatatgagtgaacttttggctgaagaattggtccatgaagacggaagatcggtcgatagccgacaggatttaggtacgccaatggcatctgatttgttgtccacatcggcatcaaatgatattaatggagacagtagcaaccagggctctgctagcgagtatgatagtgaagaggagtacgattcagatgtaattgatgagtatgagagacagctttccgatgctcagcgagaatgggaacgttctttagaacagctatggcaggcggtgacgtggattatactaccgctagcggggaaacttctcggcagaagaaccgcaggcataatatggaggaaggtgatgaaccatttatactcttgaattcaatggcattaaagagtttggcaggcgatttctctcttcatccaggtgacgaatgaatgaattcacgatcaagaaaataatttaaaataataactacggcatatatcaatttacatacactatgaacctttcgtcattttccagctgcgacattgattatgatgatgatgatgagggtgatgatgaacctcttgaaaaattaagcaagccctgacagtacggtttgatgaaactttcatctatgagtctctcaattgactccaaaataggaactcctatcattctagtctcacttttggtcatcactccgcagactcgtattagcagatcaatgagtgctgctgttaatgcgtgtgggtctagtattgatttcgaacgcccgctcttggtgaatattatctttagtctctcgtttagttgatataatagtttctcgttcactttatccgacccagttagattgttcatatcatatattattttaagtttctctaagctgaattgtaccacttcacatttcatattgtatcgcctcatttgagggatcgatagttcgaaactgttgaagagccattgttctccattacaaactcgcagtaaatgttgtaagagttcaattctctgagtacatctttcagacaccattatgtttctagcaatttgtagtctgtcgctgtggctctctgttgataactctcctatgtttttccattcgatattgattcatcctcaatgtttctcaatgcaggataatcgtgatattcattttaacaatttgattcattgaaaacaatgtctttgaggaagacgcatagaagcataaataggtactggagattctagtaaagtataattgccaaatcacagtcatctgtgagatacttatcccccggataatattggtgttccgagaatctgttgattatttggagctttatcttactaattgcagcttagagcttatttaaactaacaatctgagcgcttcattatacgcctaatgctggaccaaagtggctaactgaaattgtaataaaactgctcttgtcaaatattagagccactgcattaacaggtttttgacaccatctctgatgttcctgctatttttgttgtttgtggtgagccaggttggcttactagtattctcaccgaaatttaaggatttgatcttgtttcgatggtactaccagcacatctactacccattatttactgactacactcgttatagatggaagtactggttggttcctgggttctatgcctgcatcttgatattctgtgtccatcttttctacaacaagttaaacgacacagtcaatccatatctatattcccttgagaaagcgtttatcccaattaccattgcatttacatcattgacaggagtagcctccgtctttgttaaacctctcgggcttcaggcgggccctcaatttcagcctgattacatcatattccatccctctgcggtttgtcaaacgtgtaaaaccatcaaggtaccgagatccaaacattgcccaatttgtgagcgatgcattccattacatgatcaccattgcatatggatcaataattgtgttgggtatggcaattatgagtacttctactcgtttctattgtcaaattgtttgttattaacctacgcctctctaagattgttaacactcttcagaataactgcattcaagaaagacaaatttttcctatccttattcttattgaccactgcattctccctaattgccattgtattcacctactatcaattgaagttggtaaacgacggaatgaccaacaacgagcaggacaaatggtatctagtacaagaatacatgaggaatgggaatcttgtgaaggacatggatggtgtcctgtattacagatcgatgagcactgatgcacaaacagcagaaccgattttttactcgactaatttgtacgaccattccaaatatcatctcataaacccagctaagatcctcagtcatgaagaaataatcaatctttatgacagagggagttttttggataatttgaaggaaaggattcatctcctcgattgaatgaatgaaacaaggtgatcagaataaacaagaaattatttaataccattattactgcgtcctttatacattgtcacttctgtaaatatcaagtaataaagacaaaaaagggaaaaatcattgaatgtagcaacaaagcattcaagtatcacaatttctcctaaattagttgctgaatccaaccaactatcagcaggatgcatatggcatgttgttccctcatttcgcatctccagctcttccatttcacagcgtttttttcgtcagatgactcaaagaaattcgaattgaaaaatttcaacatcaaaggtatgctttggccagtgctaaagaacaggtatcgttggaaagtttaacaattaatatccactgattacctactatcaacattagttgaatcagagaaattcttggtacttgcagatttgtttgaattgcaccaaaacactcgcacagtcccttgctaggtttttgtgtgtttattgttaactggaaggaaacaatgagcgttgaacttgcaaaagtctccatcttggggaaagagtgcgtccacgttggttatcagattcatgagcacattgtgaagtccactttggaacattgtaagtcttctacatatgtgattattaatgatacaaatgtatccaaggttccatactatcatgatttggttagtttgttcgagaaatccctaccggaaggttctcgtttacttagatacgacgtgaagccaggtgaagctcacaagagccgtgaaacgaaggctgacatcgaagactatttattacttgaagggtgtacccgtgacactgttatcattgccgttggtggtggtgtgattggtgatatgatcggttttgttgcgtccacatttatgagaggtgttcgtgtcattcaagttccaacatcgttgttagctatggttgattcatccatcggtggtaagacagctgtggatactccgcttggtaagaactttgttggcgccttttggcaaccgcaattcgttttcgtagacatcaaatggttggaaactctccctcaaagagaatttatcaatggtatcgctgaagttatcaagacagcttgtatctggaatggtgaagagtttgcaagattggaggctaatgcagaaacgttcttgtctgtggtgaataactcacaaacagtatcggtgttcagtccacaccataatgaaactgtagaactcacttacaccaatattgaatcaatgcttgaacatacctacaaattggtgttagaatctattaaggttaaagctcatgtggtttcgagtgatgaaagagagtcaggattgagaaatttactaaatttcggtcacaccattggtcatgcttacgaagcgatcttaacaccccaagctttgcacggtgaatgtgtgtcaataggtatggtcaaggaggcagaactttcacgttatatgaatatactatctgcgacacaagttgcccgtatggtaaaaattctagctgcctacggtttgcccatcagtgttaatgagaaatggtttaaagagttaactttgaataaaaagacacctttggacgttttattgaagaagatgagtatcgacaaaaagaatgatggttcaaaaaagaaggttgtcatcctagaaaaaattggtaaatgttatggaacatccgctcacgtagtttcagatgaagatttgagatttgttttgtcagatgaaaccttggttcatccattcaataacatcccagaaggacaaaataaggtaatcacaccaccaggttctaaatctatttcaaaccgtgctctaattctcgcagcattaggtaaaggtacgtgtaagatcaagaacttgttgcattctgatgataccaaacatatgttaaatgcagttcaacagttgaagggggctactatctcttgggaagatgatggtgaaacagtagtagtccacggccaaggtggttccacgttaaccgccccttctgaagcattatacttaggtaatgcgggtactgcttcaaggttcttgactactgttgctgcattggccaagaaagatggtaagaatgaccatgtcatattaactggtaatgcaagaatgcaggaaagaccaatcggacctctagtcgactctctccgttccaacggtctaaaaatcgattacttgaacagacaaggatctttacctttgaaaataaacacagaaaccaatttcaaaggtggaaaaattgagttggctgccactgtctcctctcaatatgtctcttcgatcttaatgtgtgctccatacgcagaagagccagttacgttatccctcattggtggtaagccaatctcacaactttatgtcgatatgactatcaagatgatggatgctttcggtattaaagtcactacgtctactacagagcctttcacctatcacattccgaagggaaattacatcaatccagcagagtataccatcgagtcagatgcttcttctgctacctacccattatcatttgctgctatcactggaaccacggtgactgttccaaatattggatcggcctctttgcaaggtgatgccaggtttgcagttgatgttttgagaccaatgggatgtgaggttactcagactgcaacctcaactaccgtgactggtccaccaagaggtcagttaaaacctttaaagcacgtggatatggagccgatgactgatgcatttttgacggcatcagtggttgctgccatttgtaataacggtaccacaaacactactaccattgaaggtattgccaatcaaagagtcaaggaatgtaacagaatcgaagccatggttacacaattagcaaaattcggtgtgagggctaatgaattacctgatggtattcaaattcatggtgttaattctatctcggaattgagacaaccatctgatgcaggaattgagacttacgacgaccatcgagtagctatgtcattctcactgttggctggtatggttaattctgataagaaggatgatgaatcatctgttagaattttggagagacaatgtaccggtaaaacatggcctggttggtgggatgtcctacattctcaattgggtgcaagacttgacggcgctgaaccttcaacaacaaaatcatctgaagttaaaaaaagtgtagtcattataggaatgagagcggctggtaaaagtactgtcagcaagtggtgtgctgagtccttgggttacaggcttcttgatttagatgaggaatttgaaagacagtacggcaaaggtactgtgaaagactttgtagcagaatctggatgggatgagttcagaaaggaagaaactaggatattccaggaagcggtagacaaatacggtgacaagggctatgtgttatcttctggcggtggaattgttgaaagatcagaatcaagacaggctttgaagaggtttgccgaaagcggcggtatcgtcctacatcttcaccgtgatatcgaagagacaatcgttttcctaaagagcgacccaactagaccagcttacattgaagaaattcgcgatgtgtgggaaagaagagaaaagtggtaccatgaatgttcgaactttaccttctttgcggctcattgctccaatgaaattgaattcaggaatttaagacatgtgttcagcaacttcattcgtcgtgtacttggcgctgaaaagattcctgtaccttccaggagatcagctttcgtctgtttgactttcgaagacctatcggatcatttgtcaaaattggatgaaataacctatggttgtgaagcagtagaactaagagttgatcatttatcatccttttcttcagactttgtcaccaaacaaatctccttgttaagagctgcaaccaaatcgctacctattgttttcactgtgagaacagttagccaaggagggaaattccaagatgatgattatgatttacttgaatcattgttgaaggtcgctctgaagaacgctgttgaatacatcgatttagagttgacattgcctaacaacatactctacaatgttttgaacaagaaatcaaacacaaagattattggctcccatcatgattttgcagctaaattcccatgggatgatgctgaatgggaaaatagatataaccaagctctttctttagacgtggacattgtgaagttcgttggcacagcagtaagcttcgatgacaatttggctttggaaaaattcaggtccactcatactttgaagccactaattgctatcaatatgactgaaacaggtaagctatccagggtgctaaataatattttgacacctgttacctccaagttactaccatccgccgctgcccctggtcaattgacactagctgaaatcaaccaattgtatcaccaaatcggtggattaccagccaagaagttctttgttattggttctccaattggacattccagatctccgatcttgcacaacactgggtatgagctactaggcttacctcatcattttgataaattcgaaactgaagatatcgaagtagttaagaaagaacttttgaccagagaagatctcggtggcttagctgtaaccatcccattaaaactagatattattgatagtatgtttgaattgagcgaagccgcaaagaccattggcgctgtaaacactgttattcctttaggaaagaacaaattcaggggtgacaatactgattggttaggtatcaaaaactctttggtttcaaatggtgttcctagttctgttagtggttctgcaggtctgattatcggtgctggtggtacttcaagagctgctatatacgctttgaaacaaattggttgtgacaccatttatatgctcaacagaaccacggagaaactacaaaagctgaaatccgaattttccgaagaatataagattgttgtcgtcgaatctgccgaacaaacagagtcaattaaggaacaagtttctgttgctgtttcttgtgttccagctgataagcctttagatccagagttactaaacaaattggaaagacttttggcaaaaggtacaaatagctccttcaaaccaaccttgttagatgccgcatataagccttcagtgacccctatcatgaagctcgcacgtgataagttcaactggaatatcgttccgggcgctgaaatgttggttcatcaaggtgtggaacaattttctaaatggacaggtgcaaaaccaccatttaaagctatctttgatgcagttacccaagaatagataaaacattagatacatttaaacttcaaataacgtcacgaatgattaataatagctttctaactcccctttttatgtatgtctaatccactatttgttaatattccttaaagcattattaactgttgataggaaaaaatgaatcatgaatatataatgaaacaaagcacaattcaataggaaacatcattcgtatattgaattctagtaaggttcgtgttttttagaggtttcgatataagccacactttgagattgaatgtctgaatacgtaggggaaggtccttactcatcaccaaccttcgggaaatcactttctcttcgggttgatggtggatttaatgctgtttctatcaatccatctggtagagatgtcgtattagccagtcgaaagggcctttatgtggtagacttggatgatcctttctcagagcctcgatggttacaccatctcacgtcttgggaggttgctgacgtgcagtggtgcccgcatccggccaagcatcactgggttatatctacgtcgaatcaaaaagcaattgtatggaatctatctagaagctcttctaaagcagtggagcatgtattacatggccatttcagagccattacagatataaatttccacccgttgcaaccagaaatcctagctactagttcaattgatacttacgccctggcttgggatatgagaagccccaagaagccttattttagaaccagtaactggagatctggtgctgcacaagtcaaatggaatcacaaaaattccaatgtattagcaacctcgcactcgaatatcgtgtatgtttgggatgtaagaaagggtacatctccgttatctgtattagaaggtcatagcggaagcgttaatagcatcgacttcaatccattcaacgaaaccgaaatcatgtcaagtgggaatgacggaacggtaaagttctgggattataataaagttgaagatgaactacagatgacaattaccacagagtttcctgtgtggagaggacgatatctcccgtttggggacggatattgcatcatgccgatgataggaggaaataattctgtatatttggcgaactcttttcatgactcaggcaattctgagtcaaggactaccaaactacagccaacgtacgttttcaaggggcatacagatagagtcacggacttcttatggagatcgaggcacagtcaaaataccatcattgatgacagagaattccaattggttacttggtccaaagattgcgatttaagactatggccagtacccgatatggtttacgacaaagttcactacgaatgtggcaaagagctgccggagaagctaccagattatgattacgacacttttagatcagaacctgaaaataatatagtagatccccggtacacaaatatagaaattccgaaggaaacctttgttacaaaatccggactacgccaatggaaagctgacaacaatatagatcaactacaatggatttcgggtgtgagaatgcataacgaagattcaccgcatgatctatttgaagaggtgagtttaaacaatcttggagaagaagtcacttccgttgggcacaagttccctagaattgtttttgaaaaaatttcggtttcgacaggagagttaattattactttaaatggtccatgggtggaagaagatccagaaaaatacattttcatgcgtattattattaacttcccgccaaactaccccatgaaaggaaatgaacctgcgttcaagattgaagagaacagggaattaaaagaacatcaaaaaactcagataatggaacgactaagagaaatcagcaaaaaatatgtcgatgcaaatcgatattgccttgagccgtgtttacagtacctacttggagaagaagttaacttggatatttccgacatggaggacgacaataaaattttcagctttgatttcgaagatgtaacttctttagatagatcatctttgggttcatctgatgatcatagcgatgctcctacagagatttcttctgtatcagatgttgaattcgctgtcggggatggttctttgcaattgtattctagtacaccagaaccaaaatttgatagcacacctgtccccaacggttgtggagcagtttggaccgctcaaggaacccttgtttgcttctttagagctgagaataaaactgaaaaaaagcaacacgccataatcaatgttggtagaactggtattggaggttttgtgagatcaaaaaatgtccagagtgcgtcacaaactttgaaggataacgtatcgggaaaacaaagaaagccaaaaacttatagagaagcgctatccataaactcacaacatgccagtgaatcactaaatcaatcatcagattcggattcagatgatagtgatgatagctatgctgagttcttggatgatatattgaaaaatgatctcacactaaggactaggatgccaatgatgccacgcatattccgtgatgagacgaaatctactacgagtgtatccggaaaaaccaccgattcaaataaaaaaagcaagtcatctatagtcgttcaagattttaaaagtttgattcccgacaaaaaagagctagctgaacagtatattttatttcgggaaactcctgaatttgttgcgaagtacaatgcaggcattgcggaaagttacggctatgaagatatcgcgcaatgctggagaatgatttctaatgttttaataggaagaggagataacgatttctacaattatgattgggaccagcattcattgggtggtaaacttttagtgaaaagactattcgagtattttgagaagtgccaaaatcttcaaatgcttgcaatgatgagctgcatctttgctacgcttggaaggccagatcagaaaacaaattataaactagttccgcctactttatcagaaaacatcattacattttataacaatgaatacgagccatcgccacatgttcattccactcacggatcgttctactctaatgacacaggtacacaaaatgcgagaatgagatatggcaccaatcaagcctcattgaacgatggctcttctatcatatctgatgattatttccatcaaaatcatcatgctaacggaaacaagaacgggaaatcccataataatatgaacaatgggtatgtagaaactgaagcgacaattcccgatatcaagatcaaactaattcatgacgatgttttggatcttgcctaccaaggtctggaaccttcgttggtagatccgaaatgtgaaaccaagttcagacaatatagaacgcaatatgcagagatactttatatatgggggttgcctatggatagggccgagttgttgaagtttaatgtaaatttaaacacagaacctgaatacttgcatgggatcgaacaagattcgggattggatatttacaaaggtgtatcgaataggtggattgaatctaaccacggacacactcaacaaaactgtagctactgtggcctcaaagccggtagattggtgttcgtatgcggtaattgtcagcacgtgactcacaggacttgcgcagaaaaatggtggaaaattggcgatgagtgcccctctgggtgtagttgcgactgtataaagaacttcgatgtcagcgaaccacttatataaaatgcatcttatgtagcagtgtcttatcgttcatcttcttttaaccatcagtcgttgatacaccttctttcctgggttttaatgatatttaaacgagatgataaaccttccggaattctgaaagaactagaaaaccaaatagatggtgatgatgatgcgacacaagcgaaaaattccaggctacaggaaccgttcccgtccattagcactgatttacgtatactagtagctattgagtaccaataatttcaaaaccagcatgtcttcgtcaaaggtagcagtggtcactggtacaaacagtaatttaggtttgaatatcgtatatcggttgattgagagaagcgagccagaggacaacctcacgatagttgtgacatcaagaacattacctagggttcgtgaatgcattgatttaattaaggcttttgtcaataccattaataggactggctctgtagattatgattacctgctggttgattttaccaacatgatcagcattcttgatgcccactacagcttgtcaaaaagatacgatcacatcaattacttctttgtgaatgcagctcaaggagtttactcagggattgactggttgggtgcagtgaaagaggtcttctccagtccactggaggccgtcacaaacccaacatataaaattcaacgagtgggagtcaaatcaaaggacgggatggggcttgtgttccaggcaaacgtgtttggaccatattatctaattcaaaaactgcttccgttactccaggctggacaaggtactgtcgtttgggtctctagtatcatgtccgctcctaaatatttgtctttacaagatattcagctattggaatccgatgtttcttatgaaggttcaaaaagattagttgatttgttacattctgcaacatataaagagatgaaaaagctcggaatccgccaatatctcacccatcctggtatttttaccagtctctcatttttccaatatttgaatgttttcacctactatggtatgctcttcttattctatctggccagatggattggttcaccttggcacaacatacaaggatacaaagcagccaatgctcctgtatatgtagcaacaatggctaatccgcactttgagaaggagcaaatgaaatacggatcggcaacttttagagacggtttagaatatattaaaactgatgaagttgatacaaccggctgtgaagatgtgtataaatacatctccaatttgaaactgcaatgggatgaaaagttaaaagaccagattaagcctacaaggataccattataaattttacataattcaaataaatcgtgtagaattattgtttatcgtaatgttgcgtgcgagttgcttataagttacatattagatgaaggatcatttgaaagtagtcacatactatttgaaagtgaggacttaaggattcgaaaatacatatacagactttagagctgaagtacagtaaatcttgaaatatcgctgtattatctctttaatgccatcaaagaagcaacgaatgtcaatatcaatctcgaacggacttcgttgatgtcttctggaaccaaccagattagagctcctaactttctagcaatagaaatagccaatctggcgtttgcatatctgtcctcttcagttttaccaggtaacactaatgagtagtccacataacctggggccaaaccatttaggacatccaataagaagtgagcgttggacaacgaaggatcgctgaaagatcttatggtggatgattttccacccttggaaactgtttcttgagcccactttaagatttgggaatcagacatatctctaccagtcgtggccaattcattcattgtattgacaatattcttacgcattaactgccacaccaaacctagcgttagtagtttattaccgtcgacaatatcagagccatcaataccaaccaaagagaatcctctagatttacctaaatcaacagcatagttagtattttccaaagccttgaagcgtgaaagttcagagtcagatgatttcttgttgattaccttccagtttacagatccaggaataaccttatcatatgcctgtagaagtactaatccatcctttaagtcttcgaatagtgacacaactggaggatctacttccaaagaatttaaccacaaagtgaaaactctggcttctctctcaccttctgcatcgaaatcctcaatttcgataggttcgttttcatccaatggatccaaaccaggatgagtgttgaatagatgagcaacgaaggctaagtttaatttaggattaccagccactaatgccgttggagtcaaatactttctgcattccaatttttcagcgttttgtaaaacttcttctgctctttctagcaaatcggtggtttgtagtggtcccaatgagcatagatttgaatccaattgatttaataatacagtataattttcaccatccttgatatcagaagagaaattggagacccttctgtgccacccagcttgtttcaaatggtagttgaaccaacgcaacaagatttgttctgggggtagtcttaggaattgctccaaagtttcatcttcttctaataaacggtacaattccgggtgtaatttgatatcaatcttggatagcaaacctctcctaataatttgccaaattaaacctaagatcaaatgttctttaccttcaataatatcttcagagtgaacattaaccacaacacagccgatagctttagcggaattgatcacaatgttggcgttttcggaagccgtgaaagtgttcaaagccttgttattcttaggccagtttaacactctggtatcgatggtgtccgggacagaatcgttaatcaacttggacaacaccaacccatctctacattcgtcgaataattggaaagtatcggtagggaaaggaagcctatgaccaatgtctgcgtccccagctagcacggaattgatatgtgtagtgaaagcccttctttcttcttcattaatcgtgtgggtggtaccagaagtggaaccaccgacaataatctgagctttctcaccagtacctttgtgttgcaaaccaatcgatttaggtttagttggaaccggtggtgcacggttgctctgaccggaaatgttaggaaagctcgtttgtgggaacccctttgaattgtcttcgtcctgttgcgtaccttgagatgaaccgtttgctcttaattttgccatcaattccacgtaatcctccaattcaacatgacccgaagcatctacatcaacggtcttcaaagtctccctagcttcatcataagatgcaacaccagacttggaaatggattccaaaatttgaggtttttcaacccagcccttatcctctagatcgatgtttcgaaaatgctctatcgtttcgaagagatcttcctgagaaaactcagggaactttctttgtaatctaataatattcattattgatcagtttatattgctgtgattccaatcaattgcactaatactgcaagttgtaaaccgtataggcagaaggaaagacgagggcttcctttcttgtttcgggcgtggaatacggctttcaaggtttatgttttatattccaccatgttaaactttattctttaaagggcttttcgattggaaatggaaaaggagagagtatgtgatgttcgtatgttatgataattgaagggaattaaagccagtacaagcctcctggttcagcagtctgatcatacggtgctttacacgggtttcatcgtccgtctatccatttgcgtatgctatttatgcttgtcgcagtctatttgcattagatatattgggatattccgcactgtggaataatcttgtgagctgtgagggatgaaatagtcacaggagttaatactactagccagctattcagtgttttcctcgtacttccacgcctcattttggacaaatgctgtttggaactgccggagctgtttgtatagatcttgagatgagttcgagtaatcgaatttcggacttgtttctggcatgtcatcatccattaaatctagctgttctctccatagcgtttggtaatacggtacattgagcctggattcaggtattgctctatctttatcaaaaagtcttctcatggcaacctcttgttgttgcaattgatccacttttgtcttgtttagtatattatcatggagtatgaaaggtgacggatcgtatttgaaactgagagtgttttcagatatccctggtgccctttgtttcccattcatatccctgtttctattgcgttcattcttgtaattcaacggagtgtagagcgaagagtcgctgaatacatttgccgatgtgcccatcccaacgttgaaatcctcatctgttgagtgtttgacatgtttgatcctgcggaactgcgggcttttccagggtggcagacgcggaagatctatgttgtgctccatgtattaacttaagagcctgaacagctacagttgaggggttgaaggctggttcttggcaacattttgcctataattatgacaaattattgtgggtattttagaatgcttacctttgactgacatttgtggcattggtttaatgatcacgtgatatcaatggtaaacctaacagatttcaaacagcttggacatcccatagtagtgtcaatttcgaggtatctgattagattgttacataatatatatatatatattagatttaaagccgaaagctcacctcatgatatgcctaaattaatatgtttgtgtcttcgtgctaaatcaatccgcttaatgtcaaacgttcaaggaatggttgtagatcgtctttcctgatttcaataattgatgtctcgaaattgtcaatccttactttggcacctgtctcagctgctatttgttgaaatgccactgtgaaattatttaaagttttctgctgttgttgttgtaaaatgtccaaccctcttgggtaccttggcgcaatccctgcacaaagatatgtgtcagaagtctcatctaaagttgccaataccagtggaagtaactgtttttcgtcattttctgcatagtattcaatgagccatgatcccagcctcaataacgttaatggatttctatataaatgcaaatctggtccatcttgtaaaacacatagcctgtaaatccttaaatgtttcactaatcttttctccagaatagcgactccagtttcaaatacacttctttgtaaaaatgttgcatgcttaatcccctgagataaaatatccatattattgtccaatacatcccaacttgaccaaaaatttgcaatccattttttttgccttgtcttcagtattctgttaattttttgctcttcagcttcttcgtactccctattctcttcatcaccttggttcgtatcatctttttgagatacattagctgttgtcaaattttctagtgcgtttgaagcattgccaacttcaagtaaagcggttatcgattcgacaaattcactggcacttattgatcctcggtaaccgaaagttctcaagaacccatctcgtacaatatcttgtaacccgtatctatcgagatttttatcgaaaagtacgcccagatctctcttgaaattattgtccatatatatccagttttcctgtgtaacactcagcggaatacccatgcgtgcaaacattttatgcagtcttttcttgccattttcattccacagtgacagtttggcgttgacgtagttagaataataaaaactatcatataaggatgtatgcctcagaaggaataaactgtaatcgggacgaatctcaagattcaaagaatctggcgttttagttttttcactaggtgtcaatctttttacttcatctttcagaagtggtaatagtcgattgtataccaacgggaaggaattatccaaagaggacactcctagaatgcataaccataaataatctagatttgtctcaccaataccagacaaaagagaatatatctgaactgaaagggagttcagcaccgttgatccctgtgaatagtactcctgtaacactttttctaagttgtgaaactctcgctttcgttgtttatgtgatttttttggattcaattcatcgctggaccttttacccaatactacgtcatcgtcatcgtcatcgtcatcgtcatcgtcgtctttatcctcattttgcgtttccctgtcatcttcctcttcctcgctatcactgtcatcgtccaattcatcgccaagttcgttctctatctctataagtttgtagtatgctttcttttgctctgtcaaagactcttcgactgttccatcatcgaaacaggttatgcactgtgaaccaaataaattatccaaattccacggtctatgacaatcaagcacaaatatctccttcttaaatttctgaacaacgtcagtcttatctaattgaatctcatctaatggaccctgcgtgttttcttgtggatcaatctctaaaaaagattcaagatctaccatccctccacaacctacaaatataacgctattgatattttcgtccagtctctgatagtgatccttcaattccgaataaccaaacacgggaactaactgtgattgtaccaattgcttcttgaatagactggatagcatcttcgatgcacataacgcgtcaatgtttaaacacgaaacaaaaatcaccaactgacatgaagaatgagaactgcatcggtgaagaattttatcataagcacccacaaattcagcaatgccaatatacatcctctacctggcactttgatggcctgcagtggttttgtttgcagtctcttttccctcgtgagctagtcatctcatgtatttacataaatttctttaaaatattggtttggaatacttacacgtttaaagatttttggaaaatcgattacttgtcataaatggcatacatgcgaaatattcgaaatattcgaagagatgccaagatttacaagactataggtactaaacactgctatctgatatttcatattgcagtattacgaaatacgaagatcttaacttactatgaaactactgggaacaataattggttcagcattctttttacaagctgtgtctggattctttttcgattcaggtcaccagaatagacagcaacagcagcaacagcagcaacagcgggatgttggctcttaccagcaaatgttcctagataatgactgtccgcattatttatgtccacagacattggattgtgtgagacagaagtcggattgtgcgtgtccgttccctaattcacaattgaaatgcaatctacccaacggtcaggtaatttgcatctcaaagccagcaacacatgatccaacactggtagagatttatgatgatccagtaatgggaccagctcaacgtactgagggattcagagattgtggatggatcttggatgtatatgacggcaagatttagaatgagagatctttctttctgtatcggccataatactattacaaacataaactgataatatatatagagacatataatacagaccattactgtatttaatgcaattaactagcatgggtttatttttactcgtttgagttcttcgcggaaaagatcgttaccggttcggaacagttaatctctgttcttacctgcaacccatcttttgtataacaattcatggattttaaagtttctgaaaagctcatcgtactttgattgcttccaaagttccattaagtcatcttcaggtatgagttgttcaacgtagcataatacaaactgtttcttggctccgcccacgactctggcagcgcttgaataccaagtgtaatcatttgactggtttgcatccaaaaccatgattccatactccgcatgttggaaagggggtcctcttctgtataataagtattcgcaaccaaattttatccccgatcgtacacaccaccctttggacctgtaatgatggtacgcgacatattgatgaattaatttcttgatgtcttggaaacttttcggttccagtaccaacgaaaccattaattgttgcaatgtgatcttcaataccggcactgcataagagaggaaaatagcctcgacgggcatcaattgcaagctttctagttgaatcactgatttgccttctattaatcttaaatcttcgtcacgtatttgcatcgagtccttttcaaaagctaattctttatctctttgattctttaagaataacctttcttgttcaatgaattgttcgtctacaatccccttttgtctcatttctaacttcttggcttcaaattcagctctcagtttcttgaattcgagccgctgccttcttctaacgtctgtaacatgctctaagttgattcgatcagcatcatttagttgcaatcgagacattgttcttgcctgccagttgggttcactccgagatagttgaccagtaccaaagaatccgtgttcccataaatacttcatctgccattgatcacataccaaaatttgacctaattggttgatcttgacgtcaataattctggtttcactccatctcatcgcccaatctaatatccaggaaaatgcctgaaagggatgtttccatacagacggtacaggctgcgcctctataggcaacgcatgtttgtattgcagctgatttctatgagatcgcttcgacattgtaagtacttgcctcccgcggtcttcatatatagttactaaacatgcaagagagattagcattggacaaaatatggttttataactgatctctaattcaaaagaattaagtttcaataactaaaaactcgaataagcagtacagagttaaggagtgatattaggtttacatattttactaagaggggtacgaattagagtagagaaaggacaaatcagataccgttgtagtctattgagaaatcgtgtgctcacattgaaataaattcttcgagacatctaaaatggtttatcatcatatataaagaaaaagcccttcaaaaaagaaaaatatccacagaggtaacatatcttaccgctcactccatctggaatctatgaacagtaagtatgctggctgtatgaatcaactacagttggtttattttttggttgatcagaatacttatatatgtggcatcaaacatatcttttctcttccaagctcatcgcttttggccttttatactgaaaaatgaaaattttcacgtttgtgaaatgtcagtatcacatacaacggacaatttctatacatttcgggctctaaggaggcagagattctatgtgttgagccgggtctgggttagggctttaaatagtttagtaccatgaaatattggtatatttttatttattgttgatattgttattacggtatctagttaaagatctattgtacagttttatacttttttttaggtttttgacgtgatgttgtccatctacatggatgccatctctgagaaatactgtcttaagataatggataacatttctgggagttcggtaatgtcatgaacgacaacgtagaattcgaatgggaatgtgtctaggtatttctggactgatagtttcatgttgccgaattgatctggaatatagttcacttgagacatatccatgattgattcgttagagttaataccatcgatgacaacgaaaacgagcatgattttattttcccttgctctgcgaaccaatcttactaatgtttcgtggtcttcacaaacaccatcggagatgataatttccaattgccataggtcgttactctccatagctcttgctctttcaaagatcttgatactttcagctaccaatttcttgacatcggttcttgtttcttggaaatcaaaccattggaaagtctgagcaccagtttgggtattgaaaggttggttgaatgggtgaacttctcttacagtttcaccgaatttcacgatagataaaccaccggattcaagttgagttaaagccttagagactaaacagatactttggaaagccaaattgacagattttgattcgctcatagatttggaatcgtctactgcaatcatgatttgatattgacgcttacttggttttgttcttcttaaccaaatcttgtccttacggtactgtgaagcaatatatggaataattctcttcatattcaaccttttaccagttttgtaatcacccttcaactttgtggcaagagtaggctcaagaatcaaacgtagctgttcacttaaaccggctgccaactcgttcgtttcttgttcacttctcttccatagttcacgggcttcgtcgaatggtcttggggccacagcaacagaattttcttctgatacttcgttgtctacttcatttaagatttggtcgatatcgttttcgtcagaaacaatgtcgttttgatcccataaagcgccagagttctcaagagcatttctttcaccaatgaaagctcccttgcttttcccgttattctcttcattatcaatatcaccgttttgtacttccggttcatcgatgtccatcacatcagttgggtgtttctgatcttcatcattctcattttcaggttcagctttttcttcgtttgaatcttcatcaatggctaggtcctcatcgaacccagttaattgatctttatcagcagatcccaacgcttgcgtatcagtctcggtattggcaccgtcgacatgttcaaattcgtcaggtttctggttggagccttcaggctgttgctcttcagaattggtggaagcctctttgatttcttgatggcgtctgtggaattctttcaatgaatcacctaattgctttaagctttcttgcgcgtctttacgagatgtatctgtgatttcttcctgattgttttcctggctttgcgattgcgcgttaccagaactaccaatatcttgttgttcttcagaatcagctgcattagagccttcaccctttgcacccgaatcttgttcgacagcagcatctgtatttatttgatctttgtcatcttctacaccctctaatccgtcgaggccctctacatcttcacccttttcatcttcacctccttcttgttttggttcatcttgcgggttttcaagttcactgtctgaatctgctattgcttcttctttgatatctggtttctctgtatcatcctctttatcaagagcctcttcggtttcactattatcatctccatccatatcaacgtcttcatctgattcgcggttttcatcagcgtcagattcttcatcaatgttcgtttgttcattttctgtattttctggctgcttaccttcttcttcctcctcatctacctccattttatcctcgaaatcttcttcttcttcttcagagccatcttcttcattatctttgtcagaatccaaattcatgtcctctggtaggtccattgtttctacttccgggacgttattttcgagattctcgttttcatcatttctaacttcatcttcttgttctccaacatcttcttcctcttcttcttgctcttcaccgtcatcatcgttatctttttcttcagtttccatttcatcagtttcttggttttgttggtggtcttccggcttgacatcatcttctgcttgttcctctgatgcttgtacatcatcggcattagatttttcaggcatgttctcggaatccttctctttagaatcatcttcagcttcctcttcccacatcttttcatccaatgcattaggatcatcctcgtcaagattatcaatctcttcatctagctcgtcttcatcgtcctcgttgttatcatcttcttcttcgttttcttgatcagatgcattttcaaggtctccggcaatatcgccttccatttcaacagcatcatcttctttttcttcgtcgtcttcgtcgctgtcatttcgttgatccttgttcggttgttgagcatcttctaacaaatcctcatcttcttcaacatctttgctattattttgagctccatctccatctccaagacctgtaccctcctgcaaattgttatcttcggtctcttctgaaggaggctctggagaacagaatccatctttagcgagattgtatagcatattcgagaagatataagtcgatttgctaaatttgaaataattctctgaagttgtattcaaaatgtcattcaacatgctgaaatagtgattgataaatggcatggtaaatgaaacagctgcagcaaccattggagatgattctgccgtaaatgacgttgacttaattgtagtgacaagatcatcaatcaaagcaaagatcttgttgcagttagcaatcttgatatttgagacaattcttctattaagctcgattagccatttatcatcctcttcagatatgggagtagtattgttttcaactagtttttggacagaaattaaaatggcagtactgatccggcgtaattttccatcaagttcttccagcgaagggtcaatagtatcaaagataacatctccatgagaaagagcttgttgaagccatgattccaaaagatcatacacaaagaatgagtttgtaccattcatagctgatatagcagaaataaattccttaaggaaggcattgaagttttccaatatgttttcagtggtatcactgtatatcctaaacatttcagattgtgctaagaaatctagaagtttctgtttagacgagtataaatatgaaacagtggatcttggaacctcatgagctgtactgtcttccacgtactcaagaatgtaatcgatcaattgaggcaaccacttacatatgtgcctgaacgttccaaaattataagatagatcgaaatgtttcaaaacatggcaatccagggaaacactctcaaggtctaatctcagggattcaattttactataagtgtgcacaaatatagagagcggttgtctgctggcaatcaacgaaaaaattaagttctcggtcatggccatacctttttccaagtaggacactggaatatcgtctgttgggaaagcaattgcatttttcaatcgtggaagcaggtccaaaattctaaagaaatagacatcagaagaatctatcgcggtttctctaaatgattttgagttcgtcaacactgatacaacactttgttggatttttctaatatcttctctaaagtttgatttcaaaccaattcttttgagctcctttaaggagtcactgagtaatttactcttttgggtcttcaaggtagccaataatttcttcttttcctttttgtagactgtaggggtttcttcacgaagccttttcgcttcttttgagatgtaaagggcatactctaacaaatctgggtaattttgattcgtgattttggaaatataaatagaaagattcttctgtgtgatgtagatatcttttaaagattttgatctactttcccatcccggaatatttgtgacaatagatttggccccagaaacatcgatagacctgaagtgggagattgttactctttcaaattgtttagttactggcagagcggaatctattccgctttcgatcatagaagttaagggttcggaaagtagcgttctatatttgcgaacaatcttgaacaaactattgtgagaccggcgagagctttgcttcaaagcatcgatattcacatccttccaacttgccaaaagaatcacctctgatatctctttttcaagaagcttttttcctgtttttattttgtcgttaacaacagaagtaaactgctcatagaaggagatgatattttggagggcttgtgaaattattgatgtctttccatgcatcactgaaacatgtttgcagaatgcttttacaagtcttagacgatttgcgaattctcccaaagtgcttttactgaagaaaacattcaaagcagaaagaagggaaccagatctctcagaaacgtcaatattggcattttctgttcccactataatcgtttcgaaaagatagaaccaccaatttccaatggtctttgtactgttcatatcctccatttggaataaagccttccaagtgtgtagttccaaccttctccaagaaactatgagattagttattgagtcaacgtgagcctgtagggagactttagaagatgcatacttttgccactccaccacgaaggtgtaaatttgctctattttctgcaagagtcttgccattggtgttgaaacaggataagaaataaattctttacagacgcggaaaagatcccgcaacgttgcatgctcgggccattctttgagtaaagtgttgacattgttccacaaaccttggattacatgctgtgcctttttggtttcaattctcgaagtgcctctgtaaaagtcaaatatttcagtgttgctagaatctttgaaagaattagttttctcagacaaagtcttgatggcagcaagaaccattgattcgttcaagttatatagcttgaaatcagagcaacttcgtagcaaaataacagaagtttcagatccttttctcatcacttgactcaaggaaacatttgaagcgtcctcgaatatttcaatgtaaattttagcgatctcgtagtacgtatcgattaaagatgtggctgatgattcctcaacaggagaatcgagtgaaactgaatcttcgtaatctgggaacattgccttaaattcggcctcaatgtcatctgaattgtcattgaacttaaaaaggctgttcttttgctctgcttcttgctcacttttcattcttcgcaatgaccatctataatatagtggctgtaggatttcattcaaactatcaatcatgctttcactatctttgtgggcataacataaattcaagaaatgaattaaaatctcctccacatcgtgagagccaacattttggtttttgaggaatttattaagcctagaaaagtggctcaaaatagatttttctctggtaaccgctaagcaatccactgtaaataatggagagatgtctaattcttgtgattcattttctgcaccaagagaaataacattgaacccaaatttcatggcatacacgtaacctgcgaagatgtcgttgatatccgaataaacttcatatgttgatgagagtctagaaaggaattgagacgtgttctgttcgaacattttgaacctactatcagagattgagttgtactcagtagaagattcaagtaaggagattactggagttacatccactgttgacagcatgaatgctgaccattcatcaaataacgaatcaatcgagtgattaggacggaagactctgggcttctttggttcatcgtcggaactgacttctgggactaatttttgagtataactatcgacatcaccaaataatactgagccagcacacttccaattgtgtattatcgattcagtgaggcttttgtgagcaacataattgtcataaatgacgtagtctcgaatagcaggatcgtacggagaacttgggacatataactgcagaagaccaacagcaaacaacacccatgctttacccaaattttgtaggcttctagaactgtcaatcaaaaacagtgatgcacctaaatatttagcaaatactggtttgaaccaagtacattctgacgtggcaacttcagcttcaagttctttaattgaaagagagtacaaatcgagcgagcttaccttcaaatgcactgcaataatcttcaaaacccaatctttgagaattgcggagaatattgcatattggtcttgtaaaatgtacttagaagacttgattattgattcggtcaaaaccctgccatctcgcaacgtctgttcaatttggcctcctgagaattcgtaaaaatcgttagacttaattaagatgttctcaattagtacagggctgaaaacagcctttgtatgtgaaacaaatttcccattctccttcttccaaagtaagctgaaaatgggagggtacagagtcccaacggattccagtttgatgagatccatgctagcgacagaagagttgggtaatatggcataaatggttttcttggtctcctcgaagtcattcactaaaaatctcaataatgacgtgaattcatcctcaaaatagtgtttccttttgatcaaaaatgtagacgaaatggtattgagagttgaaatcccctccttgagcttctctaaaatgttttcagattctgctgtattgttgtttaaaatgtccatgaaaagggcattaaatgtttctgacaactgactaattagagggtaagagtcaaaaaattgtttcttcaccatctggtcaaagtcacccgataatgactcaaattgcttcaaaatatcccaggtttctgcagtcaatggataagctcttcttacttcctcccatatcatatccattgaattaccagttttcaaaacagctggttgagctatttcatcaagtaattcttgtacttggttaatatcaggtagaatcgaacatgacattgaagcccattttgtgaacaattcttgatatactcgtagttttgtctcgtctctgtcctttgaacatgaataagctccaatccacaagatgtaaagttggaatagagaattatacatcttttcgactgagaacaatggaatgttcttgattgaatgcaaagcaaactctatcaagcttttcaatagtttgtaaacttcgatatgtggtacattctttacgttacgtccgaaagctaccgctgtggaaagttccaaataagatagttcattgattttaccattaactgccttcttttgtgcgaagtccaatttcccttttgcctctaacacgtaccagattaacgagaagaaatatacggattcagaagtcaatgatagaggtgaattctgttttacagtggctgcaatgtacgaattcaaagttggaattaagctttggctataacagaactctttaccattagagagggtattctgaacaatgcgatttaacggagaataaattgcctcaacttcagaaaagacccctgattctgtaatgaaatttgtcatgagagttactgcatcacagaaatctacctcatcgaatagttgtgagttgcgcacatttctattccagtcatttaataggtagattgcgttcatattaatagtcgacatcaagtatggagaaacttctccaagcaaggacatgtcgtgtaaggcaacaagagattgaagctttgataatcttggggaaatgaatgctgataacggtatctttgacattgaagtagcatccagttgtaaagagcgtagtcttgcttcaacttcgctttcagtcccaacttgtgacgagcactcgattcctaggatttttctatcttgagtcgatgctcgaacaggaagagcattgatgaaaacctctattcctctatttctcatagctcttgaaagttctccaaatttaggatccatagttaagaataatctaaaatcgcgatgtggctttaccactctgggttttccatcggtcaaactacattcgtttatcatcaaagaaccatctgtttctaatagtgaattgattctatcgagaactgatggagagcaaagattggcattgtctaaaatcaaccaatgaccctcctccacagccttgactagcataccgtcaaaccattcaaatttcacggctgcaggctttttcatgtgctcgctcaaatcttgaatttccatattaatttcgtctatcgtagaatgcacttgagttaaggaatagaacttttggaataagtggacaaagtcagtgaaattaaaggaagacactgatgatttcttaataaaatcatacaaagcaaatgctggagaaagtgcttcagtatctgttcctgtggaaagattgatggtaattagttgttgcaagatttcagaaagtttctgaatgatgttcgcaacttttctgttcaaatcaagttgttcatatccaccaagaatatccatgctatcaacatcgctattcatcgaaaattcaattgtcttcttaccaatgattgacgctatcaatttcaccatgtcagttttacctgcattcgtcggtcctaccaatatcaacggccagttgtgtttgacacaccttagtactgattcgtatacgttgaaattacattgcaaaggaaccaggttacggagtgaattgaattgaatcactggattcctatcaattacttcggcattcacttgcaaataagaacttccgactttaaacaatttatctctactcgtaatttctccaaaaatttcatgtattaatttcatggcttcaaactggtcttcttctgttctaaatctttgttttacaatcatttccaagaaatctgctgcgttgatatcgtcacaaattgatgcggaattcaaaagttttaaccacctcaaagtgtctctaaggttaaactcccatggcgaaccagcacttccccaaagtcttctgttactaacgtcttcctctagtttagacatcatttgaatcattttagcacagacctcagagtcaacattggggtacatatgagtcgcaatcaataatagatcttcagctgttagcatatcaacataaacgacactgaaacgattaacaaaggactttggtaaaccctttctgccaccaccttggtattgcggattttgagcggcaaaaaccaagaaattagggtgacgagtaaaaactttgtctagctctggtatataggcttccccacgatgatctagacaagcatttaacccttctaaaactgattgcgaagccaaattcatttcatccaacaagacccattcacccttttgcatggctcttaggaaaggcgcatctctccaaacaaattcaccagtcctttcacctggtgcatcaaatccgaatagatcaactagatctgtctgttctgacaaatttattctggtcaaagtatttcctgtgtactcagctaaggccgaaaccaaactggttttaccgacaccgggacttccctctaaaagaataggtttgcggacgtttaaggccctaactactctcatcatgttcatagatgtggttggcgcatttacagtgaaagatccattcgagattgagcctgttgacctgctcaagctgaatcttccagattgcagcctatcctccgttacaataacatctactttttcatcaaagagtggcgttaagtcacagccagcaagtttagatagcatacggacgcattccaacttttgttccttaagccacgtctcattggcggctaagtgagcagtattgttggtacccaatgcatcaatgaaaaccatcgcagcaccatgatataagcagattttagagtcttgcagttcagccatagttgcgttgatgaaatctacccatgcaagaatatctctgagagagatgacaccagtgttagttttgccagcaccgaagtgtttggcaaaccactctgagaacttgacaataatttctgggaggtttttctgattttgcttcaatctggaagaaacaataatctccacatctttaaagtcttccatagaaggtacccagatctcggtgaaacgattttttaaggcaggagagagttctttcttaccataatctcctcccggattcatggtagcaaaaaattggaaaccatcagctgccgtaatgaaagaatcaaccgtccccttttctgccaataataagctacgttcgggttctaagacactattcaacctttctaaaacggaatcgtctgccaacgatatttcgtcaaataggaagaagctcccagactttaaagcattaactaaaggaccatcacaccattcaaatagaattttgagtgaatcccttaaagaggtgatttccgcttgtacatctggaggtacatcttctttggtttgcttatcgtaggcggataagagttcttccagcgtaacatctacatctaccacttttaaaaccttctgcagaattgaggtcaaggcggattgaatttcagatcttttccgaacaggtctttgagctcctaaaatatcaccagtttcggtgttttgatgggcatttattgtaataagttcttttttatagtagttggaaattagttgaaatatagtagtcttaccacatccagtctcaccaacaagtaaaacaggttcattattttttaagcagctgttgacaagaacggcaagccttttcattcccttggtccacactacatctgtgttcaaattcaataaagctgggtcttctaaactggtgtaatattggtccatatctagttttactttcataacggtttcaagaactcttttaacaacttctttttcctccgatgacctacatctttcggcaagtagcatgtaaccattagcagcaagctcttcgtaaccgacagcaggtcttagcgcccatctgaataaatcacgaagtgttgcaaatgaatttttctgttcgaaaagtctattggccgagcggtttacggacaattgacgatagacttcgacaatttttttggcataagatggagcaatttcacaccgttgtttaagaatgatctcaagctcgtcctgtggaatatcatcaaaatgtaattcaaggaaacgatttctgaatgctctggataacactttacgtccaccataaatgcctgctggattttgtgttgcaaaaagcataaaatcaggatgtggatgaacaacttcctgagtctcgggaataaataattctctattgtcatcaagaagtctattaagtgcctccaaaacatcagtaggagccaagtttaactcatctaaaacaatccaataacctttcttcaaagcttcaaccaacacaccttctttaaaagaaagttttccagtgtcatctgtcacataagtaccaagatactcttgtaagtcagtatgctcgtgattattgatccgcacaaatttatgaccggttatgtcggcaaggtacttgatcatagaagtcttacctgcagaagtaggtccttgaattaaaacaggaaaacgtctgccagaagtagccctaacaaggttcaacatgttcttttctacaaatggcgtaatgatataatgaggttgtggtgtaatatcagcaggtccttgtttcatccaataatgtctgaactgaacataattagtacctggagaaggaggaatttgagacatgacagaatgtggattttttattctacctaggatgaatttctctataatcccccttaataattcctctgatggtagattcaacagtgttaaaaatgccatacaaaatccttcgtacaaagatcgtcttaggccataaatatgtacaatgtccgtgacataaagtaatgttctggtcaatgtacggatgctgaaatggggtctttgattggaaccatcgacaatcttattagcttctgcaagcctttttgcttctaaataaagttcagcgatgtcgttaccaacccattcgtcgcttacgctatactttgaaatgtacttgtcaatgatagacaatagatcagagatgtcacggtcaggagaatgaacataaacttcggtaaatcttgatcgaatacctggtggtaaatctctcttaccgacatctgtagcagggttcatacaagcgaaaattctgaaatctggatgggcttttatcgattctgcctcacctttttcagatagaagtatacttctagagtcactttctgaaagcaaatcagctatgttttcaagcgtgtctgccgaggccaagttgacttcatccaataacaaccattctccatttctgacagccttcaccaaagaaccttccacaaaattaaacacaaacgagttttccaaagtagaggattgtaattcaaatgattcaactgtttgtctgaattccttccatttttccaataaagcttgtttactctcagggtcgagtttacgcttttttttcttgtcagcttcctctttctcatttgagtccttttttagaatgctatcagccattttaatagcttctttccaaagtttagcgacgttcttccattgccccttggagaagcacttatggaggagtttatagaacttctcgttcttcttcaaagagaatgtagcaaggaaaagcccctcaaaatcttctagaattggaattgcgacagtcctacaattcacaggcttgtaaccacctaatagatcaccgctctcagtctgctgggaaacgttaataaccgtcaaattcttattcattagctttgctaactcttgaactacagtagttttaccagtaccggtctcaccgactaataatgttggttcacacattttgacggcaacaccaatttgttccattaaacgaagagaatgattggtaaacgcaaacgatgtagtgttggcactttttttatgaatagttgacttgggtcttcttaggtgagctcttccaattttcacatcatcaccagctttttcgattgccggtacatgcttgttcaagaacaacgtgattctggaaactgaaacttcaagctcttctccaattttctgtactaagggctgtacggctccatattcactaatcgaaccaacaaaacaatcgacagcttcagcaaaaatatcatcatagatagacgactcgataagttgatccggtttaacaacttgattagcttcaaaaagttcggtgattctctgacttagtttaactaaatctcgaacactaatgattcttggttgaacacctttgttcaatgaaacaaattgtggatttctgtaaatatctttcacagatttgtaggtgctgataagtttcggtattaaggcagttaacaaagaaaaccttttttgtagaataagcttcaaatcgtcttcagacggctcatctacaaggattttctcccataatctcataccaatcaggtcagactcatgcgtaatgccaccatgggaggtgtgctcgtctagtcttattgttgctaataactggaaaccgttggcagctttgatgacttcacctctagatggaatggatatttctcttttttcaagaagggtaagaagaacagacaagacttcggttggcgctttgttgatatcctcgataagtacccatcgtccctctttaactgctgttgtgagaacaccggatctccattcaaaagaaccgggtttttcacctgatgtatatgtacccaaaagtagtttagcatcagtttgttcacctaaatgaattttgacaacagaactatcgcagttcattttttttgaaagctcattgatcaaaaatgttttacctgatccagccttacccacaagcattacaggcttgttgcgctgaataccttcggccaatttttgtaaggccaacttggcaccatccgtatatactagatctgactttagatgttcttcattagaaggtgcttcggagattctggcaataaatacaccacatacttcaacaatcaacgacgaaagttcattgatatcgatgttgaacgattttccagttggtctgaagttctttggataagaaacaagttcattgatttcatttggtagactatggtaatttgagagccttttagcttcagtaagttccaaaaattgataatctacatcggaagcaccttcaaatacacttaagataggttcagttgacagtttaagttgattttggaccacaagttcacaggcgtgctctgccatttcaataagcatattaagaacttttaatgacaaaaatttgatgattgtagattggtgtgccaaaagtgaattaagagtttgagcattgatatatctctcaaatctgatcttgtcatactgaatcaatcgataataagccaaaaggatcaactcgatgtcctttggatcatgagcttggtaagtttgtaacaatgcgttaaagtagtcaccatttctgagcaagaacacttcgatcaattgcgaagcttccggatataaacttgcaattctgcccaatgcgtgtaataccgtgacaaacttcttggagtcgtgttgcaaaatccatctagagcaacagtccaagaatatattcttgtaaatgtataaatgaggaatcgttaaatcttcttttaacgaggaaaatgctaaattcgacaagttctcatcggttgaaagcttggcatcaaatctataatagtcagacaagtgctgctgagtaaaagccttctggtatatagtgaagttttcctcggccgcagtaacatctaaataaattaatgcagaggacatggctatagtaattcaatccttcgcccctcttataagcaattcttctttctttcctagtcaataaacagaggcagaatagaaaatatccgtttcgatgttttgatactctgtgaaagaagtgatatgccttactttgctaagtctatagcggatctgcagttaaatgtatcctacactcaatttggcagtttgtttaaagtcatctcatctcatctcatctcatcgcttttgtttaaaaaattctcagagcacagaaaaacaccaaaaagaaataaatatttcagtgaaagaaagatatacctgcaatccatctcatcggcaaaagaaaaatggatgggtaagagaaaagaatgctttgagagagccattaacagcaagcctaaagtttacaatccatctgaactccattgtcttccgatacattcctctgtatgcaataattatggtcggtaatccagttttacgtccggttgacatgaaaatgcaacctgctccgtatcaagacagagttagagttgtccaaaagatatacacacagttaaagaggtttcaatcgagcagccctcacattataaaggcatcgactatttgggaacatgaggttgctaaaatagcaaaaacaagacaaagttacgcgttcaatgcttccattctattacgagatattgttaaatataagggtaatcttgataaaactggcaaacctaagaataatagttcgtcattaatacaaaggtcccacgtattgcaaaaactacgatctttgctactcgacgaggaaacactcagtaggaacggattttttgtcaagatgtatgacactgatccgatcaatgaatcagaatcagattatgtggaatgctatagatgtgaaactaaatttgatgtgacaaaaattatggaaccgacagtatgtcggtaccaccttcaaaggaaagtatataacagagaaactaaaaaaagagaatttccttgttgtggagcttcccttgaatcatattcagacatatctgcagggtgtatgaaagcgaaaaatcacgtttacaaatgggagaatttcacaaaactgtcgagtgtggtcccttttaaatctctcgttgatatcaaaggcgaagagaacgttttggcattagactgtgagatggctttcacatcgaaagggtatgaaatgattagaattacaatagttgacttctggtcctcagaagtagtgtatgacaaggtaataaagccactgggcgaaattatagatttaaattctaaatttagtgggattcatcatatagatgatactgcacctacaattcatgaagcagaaaaatgttacatctgtcctagcatgatcaatcaaaatagcatacttataggacatggtttggataacgatttacgagtaatgcgcatagtacatgacaaagtaatagacactgccgttttgtatccagcaggtaagtataaatcctctttgaagaacttgtcttttgaaatcttaagtcgtagaattcaaggaggagaacatgacagttcagaagatgctattgcggcaatggatgtcattaaaaaaaaattgagtatccccttggataagaagtcatggtaatctatcttctagtctagccattctttgctctagttcttctattcgagcgattaacgcctcgtttaatttcctcatttcgtttagttcaatagatataatccgatcttcaggtagcttgaacatcactgatttggacctcgtccgtctttcatttttttctactctggaccctttcatggcgttaggtgtgtcagttttccttttcctcttagcggtgtcggtttccgtttcttctttgtttaacttgtcaagtagattcgctttcaccggactcgcgttgttgatcttgaatctgtttcttatcctcgatagtgacccgtcacctccaaggactggtacattccttaacgctccagatgcctttgtaggcgaatttgggaaaactatttcgtttatcttcacaacactggatttctgacgctcgtatctatcaaggcttaaattgggcccaagtatatcaggtgaaggcaacctctttggggtttgaactctttgttgtggtgataacctggcagcaggcttctccaggagtttacgatttctattaggtgatactgaaagacgtttgaaaatttctccactggctgacgaaggtggagacgcattactagaaagttcttggagggggattttggatggtgactccattttggcagctggtgtcgtctctcttttgtttaaaacgatcatttttcccgcaactacgtctcatctcgattgaatcaaatccgtttgtttacattttttaaacaatctgtatacacaatatctcaaaaatctggataatagtcagatgctttataccgcaagagtataaaagtttatggtttgtacagtttgtacgaaattggagtctatgtgtcatgtgctatgttgagtttatcatctctttctttaatcaaatagtgtttcatcgttaatgacttggtatacttgattactttcgtaaccagatgaataaaatattggcttcgtaaatttttgttcatcctgttcatcaacgatagttggcatatcgttgataaccagtatatgtaacctggggaagagttttagaaagaagtcgaaagttctcctcattgaatgacatatacaatgatacaaagaaacgatatcttccggagttattttagtatcagtagtgtcagattcatattcgtaaaacaggtcatttagaagctcgttactcttcttagcgagttcttcaattgactttgatctgtatgcaatgcagggggacgttgttagtaaatggaaataagggattattgggtagagtttaaagatatggttgatgaaatgtttagaatgaatatcactcgagttttgaatcatgaaagcctgtttggtagggaaatattttttgagaataatgtcactgtaaacatgcttgcaactatcgcataggcacatttgattgagttcaaatattgcaaagtcgtctagttcaattacgtcaagaataggttcatccaagtcgtcaaatttacaatctatgtatttcaacgtcttgatgccagataaaatggtaaggatgtctttagataagacgtgatcaaacataaagtctaacttcagttgttccaatctagtgaggttagaaaacaaggataataggaagttttcgttgtaaaatatagacaacaacgaaatctctttgaggtttttaaagttagaaagatcgaacaaaccatactcttcgtatacatccaacgtttccgtctcgtaccacgacaaaatggaaagcttttccaaagtattcacatcaaataaatcactaaattttgatgttcttggtgcactctcgaatcctggaaaagaatcatttcgaagatttaaacatagttcagttaactgtaacttttccgatagtgggacaaagtttgggaaccacatgagtgcatcaaagtatattgtaaggctcttgatattggcccaattaaatttgtttgccatagatgttatgctagtcaagtacgaagcatatgcaggccccggaagttttgcatgcgggactatgtctaaggattttaactgcgatgcaagctgagacttggagatcgtttcgaatgtttcgatatatagaaagttctcaaaataagtaatatttgtcgcatgttcacatatgagcccggtaaaccttgtcaataaattccgatttaaatgccaagtacagtgtatcttatttattagcttgcaaagttcaacgttcttgcttagagtattgaatagcgcttgaaacttaactgatgatcgccctgcttcagaaaacacaagcgtagaccagttgttgccaaaataaggatattctgggatgtgtataattggtctttcgttcaaatataggttttggtagagtgacgccactgttttatcgtaaagttggtgagataccatcatcaaggatgatttttcgatttgagataaatatcccagtatctcaagccatatttcgttcggaagctgttcgagcatttgtgctgttatattagtgctgttttcatcaattgagtgcgttgttgcattccgtgtgcaaaagttaacaagcgtttcctgaggctaaggtagcatttgtattaattcatcagtagcttacaaatgattggcaatgtataagaatgtcacgtgagcgaatgatatggttagtacgaatttcacaagaataaatatctagtccatattaccctccgtggttttatggacatttggtcaatttgaaacaatacagagatgatcagcagttcccctgcataaggatgaaccgttttacaaagagatttaagatttttttttacaacttgaaatgagccaaattcaaaatggagtaccaagcttttcgataattgaatgattggttaacgaatatgtgtcgccagctgcgacaagtacacaaaaaaagcctgtgaacaataatacatatatactaaaaaaaaaaaaacaatgtctataataaaaaacctcctccgttcgaatcacgagagtcgcgtaaaagcaaaaataatacaacttaaaaagtaaacgtttttaaaatgagatttgtgacagcagtgaacgagaagatgagcagattcgactggtactagctggccaatgtgtcaaactccgtaaagaaaatatgcgactcctacatcgaaaagcttgaagaatgaaactttagataatagaatgatgcactgaaaaaatttggctaagatgagctgacaaagaggaagaggttaagaggataatgagagatgaaatatgcaaatgatgggagacggtgagaagatgttacataagtaacagttcaggaaagcagtaaaaaaattcagtggaaataggtcaaaaattaaaaacgtctgactctgcgcaaaaagactttctttcagacaaattgcaaattcttattgaactgtcttaaatttgagatacaattcaattttagtggaaggaagatgatatgctcattctttacccccaagcgccaaagtgagggccctacaacgtataaggataaacctggcatcatgccatcgccgttactgaaatcgtagatttgttcattggttttgatctcatcgattttcgagcagacgtttttacatggcaatccattgatagtcaaatcagctattatcgtgcaagtgaggaaaacgtatcccttgaaattaggatattcgaattgagattcattgatattgcgttgtttcctgatgtctgtgaacaaactcttcaaaatacggcagtccaatgggttagcaacattgacgtgaatagttttcattctcttattgaaataaagagtcaagtcaccggaatcgatttgtaccaccaaatccctcggatttttatccacataagggcgttggtaagagatcatatcccattctgccggagattccatttttcttttttttttgggacaaaaagcggattcctcagattcggaatcactgcgaatgatacattcatttatgtcttcactttgcatcaatagtttcatccccgttcttctgagatgctgtaatttcatagtgatctcctctcttttgcaaaatggattactagtgatcttatgaggaaggagtctctgttgtaaattaagcaagcagtaaaacttacactctcttaaaagattattgatagagatatgaccaggtacaacgtagtcgtcatccgttaagagatttaggatttcttgaaacaattcactggatctagtaacgaatgggatgaaatgagatgggggtctgatcatttttttatcgtggaacaagttctccacatcgaccaacatcgagtcgatcaaaagattaaaataattaggggagtctccgggtctatcgaagacactttttgagaatttgaaatgcttaccgccgatgttaatgaaataatagtcgtatttttgcaacattctctttaacctaggtaatctatagtacaacgaatccaaaaataaggtaatgaattctttctcatccaatattgatagaggatatccttgtaaatgggccataatagtctcgaaaacaacatccgatctatcgatggtcaaaacgtgagatgcatctgcattctcttgagaattgaaatagtcagtgaaaaaagagggaccatcgctgcttagcgatgcaccactaactttaaacaatttcgatcccacctggatctgataaatattttcatgggccaaaagttctggtatattgatcaaagcttcactagtatcgacaatatccatcttctacaaagtaattcgagtctttaatatctaacactcaggctctggaatctagtaatcttgatccaaatttaattttttcactgccaccaaagcaactgtatgaaatgcacagtttcaataaagaatcaacaaaatacaagttgaaccgtaaacttagtagacttagagttctacaagcatcccaaaatattaaatacagtagacatctgaaaaaaaaacagaacacacgaagaatcaaactataaaacctacaagtaccgtatatatctaaaacccttctgtctttgaaatactcaaaatgtgtttccatttgtaatacaagtttaaatttcaaatcccaaaatttcatgcatacatttttttttctatatgacaaacggaaaatctgaataataatgtgatatatacgcatctatatgttgccatgagcctcttggtgttaatatcttgtaatcgccgtcatgaacggatagttatctgggattcactagaattgatactatgttgtatccttagtttctactactctcgttaattcccaagtttatgctataaatttgacatttgtcagatctacgaatatctccgtcacacacaaccaatagtaacatgaaaagatatctaagtttgaattacactccagacgtattaccacggatttcgagttgtcctcaaagaatgttaacaatcgcagcaatagagcaagcattgaagtattactgtatttgcttctatcatttgaagaagagaacggtttttaaaataaagggtccatccgtctgtaatagccgtaaatttcggatcagatgtttctttttttcccttccgttaactactcatcgggtaacggaaagaacactattgcatattcatattctatagctcgctgaggctcgctgaggctcactaccgcatctatcccggtattcggataaacttaacagcaggaggctcatcctaggagctttgcagttgatggcatgacctagttagaatcagccaatgatatctatgagaaatacgacgaaaacattaaaaatattttatttttcatgagttcgaggaacgaaacagaatccgcttatacgtcgttctcgcctcttcttcatttccatgtgtcagcatctacttgaagcaaaaaaaaaagaagatgctgagtgaatttcgccgtattctgcctctttctgcaccaagtatatctcattaaataatcaggctctgttgtcatggcccatatgctttagcaaagacggtgatggaaaaaaagaacaaaataaaaaaacaggaagcgtaacattgctatggccaaggcaagtcagtttggttcctagaggtgctacgtaatatatgtatctactttgagctcgcaccttgttatgggatgaaaaaaagggtacaggccaagccatagtaggggtgtgggagtttataagaatcatatataaagaacagctttcaattgcacatcttgtcttgtgaaatcctctgaaatatcttctgccggtgttagtgtttatacgtaggattgggaatacctaagaaaatacagcaaatatgtcctctgatactctaccaaacacaagattccaatacatcagaattattccatctcaggaaggtactgaagcatgctctgctccagttgagacctcattcactgaatataagggtactgttgtgattactggtgctccagcagccttttctccaacctgttctgtttctcacattccaggttacgttcaaaagttgaaccaattggtcgatgccggtgcatctcaagtcttcgttgttactgctgacaatccatttgctaaccaacaatgggccaagactctaggtgtcaaggataccgacaagatcaagttcatcactgatgccggtgccaagttttcccaatctttgggctttgccttgccaattgagtccggcgttttctgggccagcagatacttggtaattgccaaggatgggaagattgtttaccaagccgttgaagaaaacccagctactgatgttacagtttcttccgttgataatgccttggaacaattgaacaagattaaatagagagaaaaataactataatactattaagtagtcaatattaacgtacattacttccttctacctttaacccttagcttcactttgagtagggaggttcaaaacggaaacggcatttttttatttcagtcaacaatttagaaggatagatcaatatataaatgtacatacatatggaaacataaatgtgcaatgatgagaaatacatttgaacaacagaaatttcaacaaaaccaattgtctaatctgtagcatagaaagcaaaacgctttgttgaaatagaaatcattcaaagtctcaacagtttataatatctctttaatccctcctgatcgtgaaactagatccattcaaaaacggaaaaagtagaaataaaaataaaaaggaaaaggaaaaaaaaataacgagtttcgttgggaaaaccctcgagtctgtagttgaaagttgtaatggtaacgtgacgatcgaaggaattcaatctctctcgtgtgttagcccaccaacaaaaaacatgtttacacgtgtggtttggaaactcaaaaaaaaaaacttaccaaaaggttgtatttccaaaacccaatagaaaacaatgcgaaaactgaatcggcttaaaattgccctaatttttcaactatttcattttcgtttcaattgtttaccttaaaaaattattagggcaaaaagaataaaacaaaaacaaattattttctgatattccgattgtaaaattgatttgaaggaaaaagggggataatttaaccgagttagcatttagcattgtagatatgtgcttgttgtttaaatgtaaattagaataagtattattaaagatgagaaaaaaaataaaaactaaaggtaaaaaaatcaaaggtgcactttccgtgtttttcctttgaatcaactaaaaactaatatggtctttgcatttgcatcactcatgtaatgaaagaaaacctattgtaaaagcatttgaacaaaagaagaactcagaaaagatgttttcctaagattttattcctgaattttttgttttatagatttgatatcattaataagttaacttacaacaacaaagcggcagcaccggcgaccaaagcaccagcagctggcaaagccttagcagctgcaccagtgtaatctggttgagtgtgagaagtggatggagctggagcagcagtagaagtggtgttcttttcaactggagcttcagtggttggtagtggacaccaggtggtgtattcggtgatgacgtcgttgacggtgacggtagcagtagagaccaaagcttcagaaacggattcgctacatttgttttcttcacaagaagtgatggtaaccaaagtagtttgggattcggtagcggtttcagtggtgatgttttgagcggaggcaacggcggcaacggcggcgaaagcggcgacagtagagaattgcatttttgataagtatttaagcgagtgactgaagaataatattctatgaggttttaagctaaaaatgaatatagtaaaattattataataatagtgtagaagaagagaaaagaatatattaaaatctgaatggtacctgctgtatatatactcttttttttgcctcctccttgggtaagtttctctatttcagtagataaaaaaaaaacaataaagcagtaatattttttatcatatctcctcataacaggaaaaatcagaaactaaggtttctaaatttgtcatttttttggccacgccccagtggccgcagtacaaatcgcgagatttgtttgtttttggtcatgaaagaaaaaaatgaaaaataagaaactaaaccaaaaaaaaaaaaacgccaacagtgagaacgggctttacaacggacttttacagtgggttctaaaagaggtaaaaactagcccgtagccagcagactggtattttgattacctgtcttagcgttgactggttgcttattctactagaccgcgtggtagcagacaataatgggagaatacgactcgtttttgcccctttcgtagtcaatcctctcagttcctcttcctcgaaagtagaaacgcagcaactttctcattggcgagtattttggtttttgtttttttgtttcggtttccacgtataatgagtggagttttcggtttgttgaaccgtgtttgctttgctagtagaaacttaccaaattttgaaaaaaatttgacaggctaaggctagcttacctgaggctagctagggtaagcaagattttgctaggatttccacctatggcggatttctcgttctactccgtagtgcttacatttctgagtcgttaacagcgcttgccctcaaatctaaaaaatctagaaaaagagttcctagactaatttggataaatagtaggattcgttgctctacctactcctctgcctccccgccacatgggggtgaccgcaaaaaaagaaaaagacaatgcaagaaacaccgcagttacgaaaatctcaggttcacgaatgtgtgcttatgcccgtattgcggtgttttctacgtagcggaaataaatcttggcaaatttatgttcccgttttacaaagcaacgagaattttatttcacactctttctcgactatgtttccagtttcctattctagtatataccagcttactcaccaattattgcttggtatttttgccatatttggcgtcggctggaggcaatattttactctcggtttggttggtttaagaatataccaagaagttggcctttcgaagggatagcttgggatggccaagatcgcccgtaataacccttatagtgctcaaagttcagtaataggcaaataacgcacgcccgcatcgaagatagctagcaacgcatatctatagtaacataggcaagatattaaaaaaatcccactccagatgagaaaaaataaaagatggtctcattcaagatatcagatagcgagcgatatgaactcgaaatttttcaggtagaactgagggggagattattttctacgagcaattttctacgcaatactacaaggcaatagaatccacgaaaaaattacgtagttgctgcggactctttttgttttgatttccgttgttttggttttatagttttgcgtaatcttctatatttggtaccctgtaaaaaggttctagactttgggcatttcactctttaatcagattcgttcccctttgtctgcttgcttctgcaagatggtgtgctttgtttaccctgtgcgatcgcgtttcaagggttccatgatagggctttaaaggcgctaatcacaaatctcaagtatatcgtcgtattccagagtcgcgggttcgactcatgttgagtgtaagtcagatcagtcaccagtagagaaggatgtcatggcttgatttgtaaatagaccctggaaacgccgatagtaggttacaaactacgacagagcgtcaagggcgcggccggtgggttttacctactgcaaatcatctcacggttcgtccattttttctattccatgcctagaaaaccaagaggtgtgatttcccgggtaacatcaagttactaatccgtttctatgcatctattaccctgtctcgtaagttttcttatcagatcacgttgtatgtaagtaggcggtttcaaaccatactttattcaaattgatgtctgtccaaaaactgtcatttcgacttacaaagaaactttaaatgaggaaatgtataattattgatcaagaagtacctttaacgtttatggtcaccagtattaatatgtaacgtcacggtattcacaggtgtgcaataattgggtggtcttctcaagggtttcttacttggtttatcacgtgatatcagtagaagtattacccggatgtcatgtatcataatccgccactgcccctcctgttcgcaaatcttactctacatacatacatgcatacacatataataacccaatctatcaagccgacgtcgatcctatctgtcagagctgttgttacgtcttaaataggaaacaagtacacaggcagtatttcagggttaatcacagaaccaaacggtgataaaatcttcgaaacagtgttttatataattcccactgtgacactttcccctccattatcggtgaatggacatcgttttttgccaggcccttccttttttttttagtgaattagaaccgttgaatttcatattcaagtcgttaaatttaaaaaattgaaaattaaagaaaacttgatagaaacaaaactaggagacccttcgacaacaattgctataacgttgcttaagttatctgccagttcgagcgatctcccaaagaattagattcatatacgtatccttcgttgaaccaaaaactcgaggatatcgaagctggacacgtttttccaattgaaataaaatgtcgaatgaggaatttattaggactcaaatttttggtacagttttcgaaattaccaatcggtatactaatttgaacccggttggtatgggtgccttcgggttggtttgttctgctacagatacgctaacaagccagcctgtagcgattaagaagattatgaaaccgttttctacttccgtactggcaaaaagaacgtatagggaactcaaattgttaaagcatctaaggcatgagaatttgatttgtctcgaagatatcttcttgtcaccattagaagatatttatttcgtcactgaattgcaagggacggatctacatagattgttgcagacaaggcctttggaaaaacaattcgttcaatatttcttataccagatcttgagggggcttaaatacgttcattccgcaggtgtgatccatagagatttgaaaccttccaatatcttgatcaatgagaactgtgatttaaagatctgcgatttcggacttgctaggattcaagatcctcaaatgactggttacgtgtcaacccgttactatagagccccagaaatcatgttgacctggcaaaaatataatgttgaagtagacatctggtctgctggttgtatctttgccgaaatgatcgagggtaagcctttgttcccaggtaaagatcacgtgcatcaattttctatcatcactgatctattaggatcgcctccaaaagatgtcatagacactatttgctcagagaacactctcaaatttgttacttcattacctcatagagatcctgtaccattcagttcgaggttccagaacttggaaccagatgctatagatcttctagaaaaaatgcttgtgttcgatccaaagaagagaattacagcagctgatgccttggcccatccttacctttccccatatcatgacccaaccgacgaacctatcgcagaagctaagtttgattggaatttcaacgatgctgacttacctgttgacacctggcgtgtaatgatgtattccgagatcttggatttccatcaaatcggtgacccacaaatcaatacaaatgctactttcgacgaccaagtagccgctgccactgtcgccgccgcggaggctgcctctaagcaacagcagcagcaacaacaccaaactgaagagcaaactcaacagacaatcgcctctactcctccccaggctcaagtgaccccacaacaacttgaaagtggcgctaactctaattccaattctaacccttctttctctattggccctgatccagcaaacgaaacattgacgaattttgctaatcaagcagaccaatacgtctccaaattcaaataagttcaatgtaatgaaatctgcttgacagaagtatattctttttttgtttttatttcgtattatataaagcatcttttaatcacagcagaaatgtaactatttacacgtttcttacgataaaccgaatattatttataattctgatagggcatctcaactaggaaacaattgcttaacaaaattattacaaaagtacttaaataaacaaaatctctgttatgataatacaacttgagggggtttcactccgttaagccggcttcaagacataacgaatagaaaatagaatccttcttctgtaacaaattctgaggagtgtcgaactctgttactctacctttatccaacactataattctatcactgtccataattgtgttaatcctgtgagcaattgttaagattgttctttccttaaatgcgtttctaatcgtcttttggatcaattgatccgtttcaacatcaacagctgcagttgcttcatccaaaatcaagatattacttgaaatcaacaaggcacgagccaagcacatcaattgcctttggcctacacttaaattactaccaccttcagtaagcatggtctccaaaccattagatcccatacccagtatgtgatccttcaagtgtgataaagccaatgcattccaaatttcttcatcggtataccgattagtaggatcgatgttttctctcactgtgccttcaaagatttgagaatcctgcgggataatcgacaatccatgtctcaaatcagccaaacctatagaatcaattgggataccatcgatcacaatatgaccagaagctgcctcgataattctgaaaagggcaagtgtcaaagatgactttccagcacctgttctaccaacaataccaattttctcctttgggtgaatatgtaaatcaatgtccttcaaaatcaattctagttctggtctgtaacgggtactgtagttcacaaactttatttcacctgattctggccatgatgctggtggcctatggtctttaataatatatggtgcttcgctcttcaattctgcatactctttgattctttcaacactaacaatattagtttctacttccacagtcattctgacaatccaattcaacgattgagtgatttgcaaagcaaaactcaatgatagaccaatcataccagcagttagagttccattaccaagtctaataacagccaacatagatgcagccaatatgatcacggatccgataaattcaagtctaaatgccaaccaacggttagcattgacactaggatagaatgcgctcatattattgtcaactctggtttggttgatatgtacaaagcggttctgttgagaatacccacggatggtagtcaacccccctaaggtctcttggaagtgcgcataaatgggtgacctagtaacagaatccaaccgacgcaattctcttgaggttctcaagtagtactgttgataatagatgtacaatacactcaatggtaacacaataaagataaattgccaagttgccatgcaaataacaacgatggtgaaagagaccttaacaacatttgcaaagaattgagcaaacgttctacccaaaatttcatctaccttataaatatcattcgaaaacctgtttagaattcttccaataggagttgtttcaaagaaagacataggtgcctttaaaacacttgaagccattgcatcatgtaaatacttggagccatggatagtacagaatacccatagaacaatagtctgtattaatgttgccagagcggaaccaacacctaaagctaagtaaatcatcaaatatcttgtggcatgggggttatagcctttctcagtattgacttctgaccagtgtttgagccagaaattaccaatgacggccaacagcatcgagaggattaggaaacccaaaaacacacacacgttgcgggggttacacgcacgggcgtactccatataaatatcccatttgactttaccttgttccctgtgttctcttctggcgctattttcattgtcatcaaaaccaattgagcctaaggttgccaaagaagctcttcttagagattttaggtcttcagcttcagataagttttcggtgtccaactgatttatatctacggtaatttcagagatctttgagtctgaataagattcaattccttccgacgctaattttgccaaggaagtagtagattgggaaggagttggtttacccttcttcccaaactcggcaataagcttcgatagtggagagtttgttgactcattaacttgatcataacttccctgctgaatgatttcgccgttttccatgagagtaatggagtccgcaatggagagaacagtaattttatttgttgctaacacctttgttttggaatgcaacaaaccgtgtggacccaaaacgtgttcaatcaaatgtttagcgacatgctcatctacagcagcgagaggatcgtccaataagtaagtatcagcacgagaataaacggcacgggctaacgatagtcttgctttttggccaccagataaagaaatacctttttcaccaactaaagtctggtcaccatctggcaacatagagagatcaatactcaaagcacacgcttttatagtcagctggtaaaattctggatcatacttgtgaccaaacaagatattatctttaacagtaccattcataatccatggaacctgtgaaacgttggcgacgtcaccgtgaacagttgcgaaacccttcactctaatcaaatctcctagtagactttgaataagtgcactcttaccactacccactttccccacgatacatgttagttcacctttcttggcaacaaaatttatgtttttcaaggcaactttatattcaggtttgcgttgccataagaaagttgcatcgttgactttaacaccttcgtcaccaatattctttacttttggttcacgtaaaacggcatcattttgcaactcttcgttagtcaaaaatgcaaagagtctatttatggacacagatgcttcaataaatgaagagattgcattaggaacaacagcaagagggaatgacaataaattgaaaagagttaatgcagggaagactagatcagtggataatggtctttcctccgtgtatacgaaaacagcaaaggtagaacatgacacaaggaaaggcacgatattgaactggaaattagccaatgctaatgtacatcccattttcttcaagttcttcaattctttctcgttcctgacatgatccaatttggccttgtatgggatttcccacccgtaaactttcaaggacttaatattgttcaagatttcggaagtgactctagttctttcatctttgttcttcatttgaattttctgcaattttttttgtatcctcacaataacagaatttatagggatcatgacaatcataatgataacaccaacccacatgcatggacctaaaagcttgtatagagaaaccaaacacaacacaatttggaatgggccggaccaaataatttggccccattgagttaaatcctgtaatctttgaacatcaacactcattaaattaacaatatcaccggtagatgaagaagccgatgcttcatttgatagaacaagggccttttgatagattacagatgtcaaaccactcttgatattcatccccgtatcgaaagcgttcaagaagtattgatgcaaaatggacgtttgaactacacttacaaagaacatagccaaagataacatgacacctttgactaaaggaagttctggctcaggtgtggaagtataatctgaaacgaacttgatcaaaattcttaacaattgaggttgggtgaattgtaaaatatcataagcaactttgaaagtaccacctaagagtaatttaccaccaaacgtagttaacatcgcccaagataaagatggattggccttgtgtttcaattgatactgccagcgctcgccgaatttctcggagatttcttttgagccgaaactttttggcaacttgtataaatccttctcagtcaaatatttcttgtaacctgttttcatcaattctgtcatccaactgaaacttaatctttggaatatatgggctgagtccactggattacgtttttgcttagaataggattctatgactctctgataagaaggcaatggcttttcgaataatgattccaatagtaaaatcatcacagcagagatggtctggaacacagttaaaatgtacacggaatatgacacgggcaattcatgttcatcaccgtaagcatgtctgatactgaagttaatccatttggatccttgaaataaactttcgaacaaccaatagaagagaactaccccgttagaaatccttgatctgtggtactccacccaatgtaacattaacgctacaaatatggataagagagttaatgtatattgggaagttagtgttacactttcatgtttttcgctagaatagtaagcggacattgaagtgaataacaagaaacacccaactaacccgattcttgagagcaacaaccaatcatgtttgtatttcacccctggatgctcagctttactcaatttaactaactgataggtaccaaatattagcatgaacaacgctgcaaaattcaatagtacaccgtcaataaagcaaatggtaaagtctccgaagtacgatataggaccgaacccctcatcatcacggcataaccagcatgcggtgctatttccagaaacagctgaaatcatttctgaaaccgaaaccgtttgaaacatttcgcaatcacccgtgggaccataaattgttttaatgaacgtaccagtcttcttgtttaacctttttttttcgattaagtggcattttatgctttgtcttatatgctgttctttttttttggaatttcttgtatctgcttcgtagtattacaaatataataaaactgacttccaaacactagaaaatctgttcaagttcagctgcttatttcggagctgagccatgtcaagctatttactttcaaacgactactgagcaattggcttgtagacgcaccaatgcgtagataactactctttgcaatatctttcctccggtgaacaacttggcctagtgcatttcagccctagacaaatatggctacactcatttcgacatgtttccaataaggtggtttcgtggtctagtcggttatggcatctgcttaacacgcagaacgtccccagttcgatcctgggcgaaatcatttgtttttttaattttttttgttttttaaacattagcagttcccgtgttctgcatttgtttacgttttcagacttgaattttaaaatcaacagtaacaattgcaattaatcacgtagaccttacaaatgaaggtgctcatcggtagtttttcttactccctttagattcattaccatctgttttgatctccgagatacttaaagagaatcaactaaatacttcatggtctaaatcgttcaagttgtatcctctaaaaatgtcaaattttcagctcacggagtatctttcctcgttccaatccacagataaatcatcatacggagcccttgaagcacctggttccactctcaatcaggtaacggatgttttagctttaaattcagagtatgaaatagcagatgaaatctttgagacactaacagatttgactcactcgtatctacatttgaactataatgtgaaacaacaactggtatatttggtgtcctcgtgcctatcaaacttatcagcgctgatccaatctaactttcaagtcgatgaagaggtattgctctcatggaagatcaacctacaaaaacttggatacctggtacatgttttgttgattttcattcaagatgatttgttaaatcgaactcagcaacagcagcaacagaagaaagaagaaacaaagctatactcctcattactcgaaatattgctacctagtatcataaaacttgcacagataccacagctaccgaaacttttcggaaccttgttggaaagagatctattcattggtcttttcttgaaaccgcttttcacgttagtcgaatgtgaatcgctaatcaagataaatcaaatcaccaccatgataattagaaccatagctatatttgtgaaaaatgacaaccaatcgcaactagtacaaaacttcattatggccaatctaacttattttcctcaacttacaaattttaacgcagaactattgacctatatcaatgatgagttcgactatcctcaacttaccgaggacatcttgaggaatattagtaacaaggagtttaacgcgaaagatttgtccggaccaaaatctatatctaactttttaatcaagatatctgagttatcccccagaattgtgctgaggcaaatgacgtcaattataagattgttgaataactcgtcatttacattgcgttgttcagtggtcgaagcatgcggaaatattgttatagacattgcatctgaccctgatctataccaacattataaacagcaaaatgacactttaattgaactgcttgaagagagattccaagattcgaacccttatgtcaggtgtaaagctattcaatcatgtgtgaaaatatgtgacctcaaaattaaatttaactaccatagactgttaattacttccttggcggtacgatctttgcaagataaatcatcattggtgagaagaaatgctgtgaaattgttatcacagttgttattaacacatccatatgatcagatgcacgggagtcaattaaagttacgtgattggaagcaaagactgcaagatctagaatcacagaatttcgaccctgacgacgaaaaagtgaaactaactcgccaatattataaagatgccatctcttttattgactcgttgcataacgctatcgaactctgtgtgcctttgctattttctcggaataagtctgaagtactagaaacgatggattttcttgtattatgtgatgctttcgacttggaattgagttatattggtgtcaagaaaatgttacatttggtttggttcaaaaactctaatgatgaaggaacgaacattgcggatcatttagtttcttgttataaacagctatttcttaccactcctgaccattttaactataaagaaaggtccgcattcatagctaacaacttaattaagttgacactcgatgcatccatatcagaccttgcctcactagaaagactaataggattaatacatgacagcaaattgattgattataatgatatcaatgcgctctggttgatattccaaagtctgttaactggagggcggatcggcacaacagaattttcctcttctcaaatccatggtgcaataactgtgctaggaatgttggctcttgctgataatgaagttggattacacggcctccctttcattttaaaggttggattcgatcatggcaatctaccaataatcaaaatgacttgcatcgttctgcaaagaatggtggcacctgatcacactgaaattccacaccaggaggaagtattgaagaaccttcacaatctcgtcatttcatcaactgatgaccatgattactactcaatgtgtgagcatgcaattaacgcaattttcgaaatttccgaaagacccgatattatttgcaataccttaataaaggaaaagactatgataacttttggcgagcttcgtaataagaatattgagcattcaagatcccaagcaattgttgagtctagacttgcttctctttgtcagttattattcattgtgggacaagtgtgcattaaggtaatagtatttctagaaaagagtgaagcaaaattcaaaaaatccaagatacaattcgaaacactgaaatcggcagctaatgaaaacaataattctgatcctgatgcttctgttggaaataccacagaacaacaaaaggaattggatctcatcggaggtactaacgaagatgatttctcagatgcgattcaatatattaaggaaaacgagctattatttgatcccaattccttactctctaaatatggtccattggtggaggagattgttacaaactatgataaatttaatgataagtatctccagagaaatgctgttttgtgtttgacaaaaatgatgtgcgtctcatctaggttctgcgagaaatatttatcgcttctaattacaattatggagagatcacccgatcctattattagatcaaatgctgttctagggcttggtgatatggctgtttgcttcaataatctggttgatgaaaatacagattttttgtaccgccgtttacatgatgaaaacctcatggttcagaaaacttgtttgatgactgtgacatttttaattttagctgggcaagtgaaggtcaaaggacaattagcccaaatggctattctcttggacaactcagatcaaagtataagtgatatgtgcaaactcttcttcacagaattatcaaccaaggataatgctatctataatggatttattgatattttcagtggtctatccaacgacgagaatttgaacaaggactccttcaaagtgatcataaaataccttctaacgtttattgacaaagagcgtcaccaaaagcaactcagtgagaaattgctgggcaggctcactaaagctgaaaaccagaaacaatgggatgatattgctttcgtgttaaaccagctaccgacaaaatccgagaaggttcaggaagttctggaggaaggattcaaactcgttagtgctagggaatgagaagtagtccgataccaagctagaactgtgaatgctttgatgatacaattaaatataaacagattacgatacaaaaaataaataatagataatatctacatgagaagaatagaattaaataggagggctcgcaaatgttattaacaaggatgaagctgacaacgtcaatttactaatggaatgaacgatagtaaaggatgttgataaaataataataatagtaataataataataatcataaaatgatagttcatagtcgtaagcaacgtgaaaaaaaaaacattgatgtaatgttatagtccaatttctgggaaaaagtacactcaggatatagcagttctcatcagttcagcttggttggattctcagcaaacacttcagctgcagaaatgataggatcacttgatttacccaaggtgaaatccaagctcaattggttagaaaagcgaggaccattgtcaagatgatttttgaccaagtcgaccatacctttgatgtaggtttcactaccgtttaaagagtcgcatcttttgatcttgtccttgtacttactctcagcaatgatacctagatctacttcatgcaaagtttcaatatggtccgatgtgaatgcgattgggacaagcactaagccaggttgagttggtgccaaaaactcagtgatatcagaggtttgagcacctaaccatggctttggaccaacctgagattgccaaaccagtctgtatgggtttctgaagttaagttctttcataacgtgataaactgtagctgccacctctgcagggtacgcatcaccggtatttacaacgtccattggtagagaatgtgcagagaataaaataacagcattatctctaatttcagcagggaactcttccaacttcctggtgatgttttctgcaaatgctttaatcaaaccgggttgagtgggccaacggtcaatgacagaccaggagatttgtctctccggatctaagtttttaatttgtctccatagttcattaatggaggaaccagtggtggaataagagaattgcggatattgtgaaaaggcaactgctctagagacgccatctttcaacatctgttcgtaagtctcatgcgtcaatggtcttgcgtatctaaatgcaacgtaaggcttgtgaggagcagtctgtggatgaatttcatccaacagttcacagactcttgcacattgatactctgaccattttttaatcggagaaccaccaccaatctcttcgtactgtttttcaatcttcggtgtacggaatctagcaatatattttgcaatgataggctgatatttggcactaattggaatcaaatcgtagtccgagaacaattggtataagaaatcataagtctccgaaacctttgaaggcccacccatattcatgaaaacgataccagtggggccctttttggcctgcgaatggaaacgatgcacataatttctcagtacaggcgaacaaaatgcactattcctatttcttaaagctgaactgatcatcattgcctagtgtcgaaaaaaataaccatccaaatgaatgcctacttaatttttaatgcgtcaaggtactgctatcactattaatgcccccaaagtaaacgcttaaaaggaattccaatcctgatatatataaataaatccccagtgactaaacagtaaatcttatcagcaggtaaatctctcgtatgtgatgcaatgcaaaatggataaaataacccaccacttaatgtttaaatcaaacttttattcactttcttccaaaaagcactcctgctccgcaatgcagaaagtgatgtaataaataccgaatatcaatgccaactaccagaatcaagaattggattacttacccaccttacacgaagtatggaaacaggattcccatttcacttccgacttattgatgaggcaagcgattcttcacttcttgctttttgcttttggtgaaatttcaccatcaactgtcatttctttttctcgccaatcgttcctagaagaaactaccgttcgatgccgtgggaaggcaatgccaattacgtagcagtaacggagcttgacgcctatgtttaggtttagatttgtcatgcaaactgcatgttcgagagtcaaagtcctgttctgttcaactgggtgtatcctatatggactgttggatcaataatgactggtgcatagatttttatttactgtttgttcttcaagggtggatcgaccaatgatgcatctgcaggcatcagttgaaatgatttgtttagcattgccaatgtagagattaactcaattgactgcgtagcttaagggtttgttttgagcgatcgtatttacctatggatcgggggaagattatctctacttcctcgcatctcacaatatatagtgaaacaagaatgtataaaaacaaggatttagtgacgaataatagactcgtctaatctacagtaacttaaagctatcacatgcttcgttaatgtcatcaatgtataattcgttcacctttcccttctttctgtatggaatcctgttcaacacggaaaaatgttggaaaaccgaatttttttggaaacagaaaaacctttaaatagtgtcaatgcctatttcttttaaatctttgatccaatacatagacagtaccccctgagtcttctgaggctgttgattagtgattgttagttccaattacttaagtagtcaccagttttatagactgaaggaaaggtcgtcattttctggatgaaataatggtgtacaatcctattcatgcaaagttagaacagctttctgcaaattgtggtatagatgaagttactttgaaacttgcgatctgtttgtttgcatcttttccattgaatgggatcttgaagagattaccagataacaacatccggttgaaatgttatttcatagttgctatctcagctttctacatctttgggatattaaacctgtatgatggattcacgacattgttcattagcacaattttcacattcgtagtgactagatattaccagtccacattcatgccgtatgtgaattttgtttttattatgggccatttagctataaatcacatgtacgcccagttttatgccacatacgatccaacaaagatcgatatcactggtgcgcagatggttcttgtcatgaaattgacatcgttcgcttggtcctattatgatgggactttagctgataaaaaggatttaacagaatatcaactgtctagatctgtgtcaaggcatccaagtcttttgaaatttatggcttatgccttcttttatccttctttgttaacaggacctagcttcgattatgccgattttgaatcgtggttgaattgtgagatctttagagacttacctgaatcaaagaaaccaagacgtaagtggaacaaggatcctaacttgagaaggcagattcccaagagtgctggtgtagcccttgtaagaatcgctcaaggtattttctggttggtacttacctttttgatcaaggattacgtctataccgactacatatttaccgatgagttcattaacgtgagaagcttcttctacagaatccactatttgttccttctaggattctcttatagattgaaatattatgctgcgtggaccatctctgaagcttcttgtattgtatgtgggttaggttacaacggttatgacacaaaacttaataagatcaaatggaaccgtgtccaaaacattgacatttgcagattggaattggctcaaaatacccacgaatccctggaggcttggaatatgaataccaacaaatggttaaagaattacgtctatctacgtgtggctaaaaagggatctaagccgggtttccgttcaacattattcacattccttacatctgcattctggcatgggaccagacctggttactatctaaccttcgctactggggccctgttccagacatgcggtaagctctacagaagaaacttcagaccaatattcttagccaaagacggtaaaactccattgagatcgaaaataatctacgatgtaatctccttttatgtgactaaaatttcctttgggtatcttgttcaaccatttgtcattcttgactttaagaaatcattatatggatggaaaacggtcaatttttatatccatattggaatactaataactttctttgcattcaagggtccattcagtaaacagtttaccaactggttgaagagcttccagccagtgcaaatagaattgaagagacaaaagaaaatggagaaagaagtggcagcaacttcgggtacccttggttcagttatagccgataagcacgaatttgagcgcgatgaattagaaggcgagcttgagcatgctatggatctaggtattccttctgttagctttgacaaagaacaattcgataatgcaagggaagacttacatgaattcagacgtcaatatgaagagtggagaaacgagaagggtttggaagttgaagaagcgaacttgcgcagagcctacgaaaatttcaccaaacaactccaaccacagcacagaagaatgagtttcagcgattattcaccaacaccaattagaaagaaagaatagctccagaaatctttatgactgaatgaatatacgtttgaagaattacagtgttaatctatattttggtagcatctttatagttaatttcttacacgaataataataattttatgatatacctttataagctctctctttgtattaccgtttatcgaaaaccagtatcttgccctaaaattcatctgggttaaaaaggtccaaatctagatccagctccaaatccgggttttcttcagatttcgtctctgaatcctctttcccatttgctgtgaactcgaacgaacctcttctttcagtatcttcagttgcatcctgtacttgttctttgttattgaatctatcatcaacagaatcctcattggtgttgcgcatttcatcaattttactagtattattatcattattaacattatcctcatccaaagcgtcaagtagtaattctttctttttgagagaagccattgccaacataccttttctcaaagaatcctctgctggccatataaagttattcggtccaatcattgatttatcaaaagtgggtgggaatcgggtgaacttagccaatttcattgcgtaatccaacacgactttggaatgaatcttctctctctgttttaacatgactttttgttcaaactcaacttgctccaacatgggcagttcattcaacgaattatagcacgtattcaaggtctccaatatttctcgcgttttgttgtctatatttttctgttccttatccagcctgctcaactcttcctctatcttgtagtattcatcgaattcctccaatgtttcataaagtttcttatcacactctattactttatcgatcaaactgagatcgggcttgaaagtgtccacacttttactcaattgctgtatcgtctcttcatatcgttctaaatcttggtatattccgactgactgcagctcttcacttacctgttcttgggtcttgtcttgagccgaaaaaggtagcgtggctaccgatgtcgacgagggtactggtccaggagtactcatgataacccggtactttttacactgtttgtaagatacactaagggctaccagctatgtcgtcttcggttcgcaaggcttcctttgctgattcatgtcatttaagtgaatgctttaaatgttcgaactttctgaacaatggaaaatgcctgtttacatgaaattcatttggtaagaatcaagaagacaactaaataagatgctatgtcactgaatatcgcttatgtgctgtatgtactgatctagttatggtgctgcgtttaaaatgtggtatactctcttcattgatggtcttcttccgtgaagccaggacaatgcgcaaaaaggtcagcatcgtctttgtacttgttaccacagtagaaacaataccttagttccgttcttagaaatgtgtttaatttcttgatcttctcatctatggtaagttgttgaagcatttccaactcaccatcaactggaatcacatcgtttgatgattgttcagggtggtcatggttatgtccatcatcttctgattcatttcctagacttttatgcgttaagttctgcagtaattctatcacatagcttcgccataatacgttgaaatctcttggatcactggaagagtagaagttatcaacgtcaccagtcaatgtgaaagcaagtttttgcatgtgttttaataaatggagtttcctttcagtatttttctcgttattaatccgttccctaaaatcatccacattagcgacgtcctcagtctcagataacgctggtttagttcggataccaattctatctagtttacgttctacaggtaccatacctacggtacgcttagagccagactctgctgtttcgtcaatgttatagcccatacttttcatcatcttcaacgctttcggcagtctttttgccaatgggatgtcagatgctcgcagcagaggccctattttatcaccatgcaggccttctatttccatagtcaaatagttttcttcccaaggttcttcatgagtgtcctcgacactcgcttgatctctctcacttgcagtgctctttgcatgacttaatttccctgatttcttcaatggtctttggagtctttcttcatcactagaatcatcaccatcactcagttccgccaaactacgttttatcatagtaaatgtacccctaaagtggctacagctctttaacgggatgacactcttgagatatgcaagttgtcatgttgatgttaagaaatcctgtcataatgaagttcacactatataaatcgatgtaggtatagaaagtgaaatgtgtaaagaaaataaaaccgttaaataaactcagatcacgggaagtccaggttagatgtctcttttagatatattttggttatgtataactggatcccttttgtgttatcattcaaagtcattagtgatttctggtggttcaggaattccgtcatcttttagttgctgttctagttcttgctccaaaccatttttccagagatggtgattctcaccaatgacatatgtcatagttctgttcatgtagccctccggtcccatgtagttcaagttttcaatgacatcttcaatgagatgagctttgccaacagcgataccgtcacccaggcccgaatgtctgacgttaacgatgtgaatatggaaatggtagtatgagggttggtaatggataaagagtcttagttgatcagcgggaaccaagtaattgtagcaactaggaaccacagatcttatcttattcttcatatcgatcaaccattgttgatgttcgggtctcaagtctcttaacgatttaatatcgtccctatgtacaatagcaaccaaataaagggcatccatattgacaccatcccatttcatatcagggagcaccacaaagccgtctttggggctctcttggtcgaagtacttgaacacgaccctgtcactctctgctccgttatacaagatgttctgaacccattgcaacctaccgttattgaccatatcatccacataaggcttcacgatacgcttatatatctctggggtttccctcaccatatggcacaactgcttatcgtacttctcgatatgaacctgtgtggcaggccatatcaagttgatctttgccgtggggtttaactccaagtcctgcttcatcacagacatcccccagaaataaatgtcgttatttgctattggtttcaacgtctgaatggaattcatacaagaatattcagattcacattggtgcaacgacaacgtagacgaattgggattgttcaccactttatcaaactggaagtgtgtcttctctagagtcacgatagcatcctgacccttaatcgtacctaataatgaaatttgcttggtttgcggattagagttcaagaccctgctaaatcgaaactcatcgatcaaagctctgaaatcaacggcatctgcatcattgtctcccatattgtctattcacgagtactacaataacctcaatgtatctatcgtgttgtataccgacttgtaaactctattttactttactttcttacatgatatttccctcttcccttaaggaagatcatctgctttttaaaggtttttcatgttgagaaaagaatcgttcaagtgcaaaaaggcgtattgatgatgatgagacatacgttagtcagggcacattcagagcaatactgagccaatatttgtacatttttttgctgaagtttatacagggtggaattatatacatatttaagtgtacataagtgtatcgatacttctgtacagcgaatacttcatcttaagaacatccaccacaataagaatacgaaaaagaatgctatgatcgcaattggcgcgtactggctaatcaataggtcgaagttgatcttttgtgcggaggctctgtactttttagcgtcttgtcttagggacgcactcatatcactcatcttatccaaggaatcacctctgtacaatagatcttcgatgttttttgtcatgatttgtttgacaccttttagatcctgattcaattggtccatgttcccctgtactcttttgtcgttgtaaactttcttggtcttttgtaagaagttgtcgaaggatacgaactcatacggtctaacgttcgatttcgagagttgtcccccgtaactgtgttcgaattcttgttgtatatctgccaagtatgagaatgccaaattacgtggatagttcctttctgcgaccacaatatagaccacggtgttcaatctgatataatggatctcgaaatcaccactttccactgtagcctcgtttgctgacgtcggagtgaatcttgatattaggatcttcaccttcttcttttgctcttgtaaactgggatcagtgtcatcatccactgaggcacacaatggtaacccatcttctctgaaaatcaacgtagaacgaatcatgcccgtgcctattgccttgtaaatcacttgctaaaactgaaagatcgttcagtgcttggtacagggcaatacgttttctaatttgctgaagtttcattcattagtgatggaaacttggttttgattcgattgatttcattccatgttgaaaagacgagtttaaatcgaataacgtggacaaatacaaggctaaaaagtgggagtatgaaccccatactgactagcatggtgccctaaccatatgagggctacgagaatggaagaacgtatctgccagagacggtttcccagctgtttcttctgtggtgttgcgcttaatgattcggtcctaacacgtattatttaataattaccctgaaacaagagtctctgtcagattcacaattgaaccaccgatcaacgtgtatttcatacgtggccgcacgttcatgtatccttcaaactgaccacagctggtaagtcacagctatgtgtcttgtgtaccctgttgatgaaatcggtctgagaaacagtctatatatatagtattaaggaaccgaagatgtcagactttatcaagaccgacacctcaagagtaggacgtgagaatcagttgtattcaagtgtcactggtgctagactcgttgcaggatgtataatactggatgaaagccgagagaatgtcttaatggtccagtcatccgctcataagaagagatgggtgttgccaaagggtggtattgaaagtgatgaacctgactttgagtccgctgcaagaagagagacctgggaagaagctggtgccacaggcgatatagtgaaagcacttggttccattgaggatatgagacctccaaaggactggaacccagatttggaagcattcgagagttcgaatgacgaaactgttaacaaatggcctcccaggtccgaattccatttcttcgagatgattaatgttaaattggaggacaattatcctgaagtgaagacaagaaaccgtcaatggttctcctacgaacaggccaaagaaaacttgacccgtgccaagaggccagagctcattgaggctctgaatagaagtagcatcaagaaaagttagcattatatataacatagagtatgtttataccgaagactattattatttacctccaaagaaaccagacatcatatcttgcaagaagttgattggtttctcgaccttgataccgaagtattcttggcccaagaattgtagctcagagttgtatttgttggcaagagttgagtattgtgattttagattctggaaaagaatagtttcttgagtttgacatgcgattattaacaactgtaaaaagttcaacgattcccacgatgagaaataatcaatcttatatgggcctttctctgttaactcaaattttacatctgtcttgtgattggtaaaccgttttaaaagttctttagatccctccaatgcatattcgatattgaagatgaacaaatagttgaatatcattcttgatatgaaatcggggaaactggagtcctcaccggattgctgataccagtcccaaagtagatccacataccgcttcatcgagtcatgagtacctagcactagatatctttccgcttcgtatgtatatccaccttcaagtaattttgtagcgatcgctgaatgtaagtatgggtcaccaaacttatattcactatgtttcacagaccaattgttcatccctgtcactacatcctttaaatttggttcctggccgtcaacgaggacgagtaattgaatgagtctagagaccgaagagtcattgcatggaaccgatgccaaatcgtaaacttcaagtagatagaagatcaaatctgaaccagaaccaccttgcttggacctcaaaaacgcaccggctgcatgagaaatcaaatcaatcgattcatcatactttttggcccgcacatatctattagcaatggttcttaacgtctgatgggcttcataataatcaccagcttcaattctcgcattgaatctctgtaaggtcttcgttaatttatcactcatctctaagtgtctcgatcaaaaaacaattaaggtatgtaaaaactcgcctaacggattcaaaaggcctcttgataagtacaaaataacttgattctgagaaacacgaaagctgtggttcactcgttggacctttacaatatgatcatgttctttctttctcttcctggcgaaatttcggaccgttaaaatattgaaactcaacaaaaccaatattgaaattgactcgttcattaactattctgatgaaagatagggtaaaggacaataacagctggagcagcagctgagctatattgccaagggatttaattacaatttagaaccgagtaatatctgcttagtgaggtgatacatttcgtttttgttacattattaagggaacgctgtcaaacagtagcatgagtgatctcaaagaagctattcagctcatcgatgagaacaaacaattcaatccctcgacattgaactatttcacgaagtgccttggggataaaaatgttggagtaaagtatcatgtcatatctgtttttggatcgcaatcaagtggtaaatcgacgttattgaataaattgttcgatacaaaattcgataccatggatgcacaggttaaacgacaacagactactagaggtatttggttatcccattctgccaatatatacagctctggagctgccaaccaatccattcctgatttctttgttttggatgtcgaaggttcggatggtgcggagagaggtgaggatcaagactttgaaaggaaagctgctctatttgcattatcagtgtccgaggttctaatcgtgaatatgtgggaaaaccaggtcgggctataccaggggaataacatggggttgttgaaaacggttttcgaggtgaatctttcgttatttggcaagaatgaaaatcgtcacaaggtagcattgctgtttgtcattagagattttaccggccaaacaccattggaaagtttagaagccagtcttgtcctggaattagaaaaaatgtggtcacagctaagtaagcctgaaggttgtgaagatacatctttccatgattttttcgttccaaatttcttcggtttgggccacaaggtcttccaacctgaacagtttgataatgatgtgaagagtttgggtgacttgttcgttgaccaagatgcctctttcttcaaagatgaataccatactcacttgccattggatggatggtctctttatgcagaaaactgctgggaacaaattgagaataacaaagatcttgatttgccgacccagcagattctcgtagctagattcaaaaccgacgagattgcagcagcagcatacaacaaatttttgaatgactatcaatcacaggtcactgactccttggatgggaaagaacttgcaacagtactaaaaacattacaatcaacctgtattgatgtcgactatgaccctttcgcctcacgttacgcgaagaaagtgtatgaagaacgtagagatgatttgatcaaacaattaaatacgataatcgacgaaacgataacgaatttcgttacaagaactacttcatccctcattgaaactttccacaagaatgcaagagatagaagtttgaaggggccattcaagctgaaaatacaatcagctctcgagaaagcatcaaggacgttcaaaacaaaccttgctccattttcagaacttgaattattatcttccatggatgcatatatctctaaattcgaagctcgcgtcaataccgaggttgctgatcttcaggagcgtgaacttaatgcgatagtagcgaggttcaataagggtctaactatcaaactcaaggataccatacttcatctacttgctaaacctactatcaatgtatgggatgacgttatgaaagaattcactagtttcttagatggtagtttgaagaagtacactaatgaagacggtaaaatagatttccaaactggagccactactgatgcgaatgacaaaacagagcacacattaaaaagaaatgcttggtcatttttagatcatacggttcatgggtatttgactgaagataatgttgttgatatcatgagaaacgtttttaacgacaaattcagatacgatgatgacggtatgccgaaattctggaaaaatgaagcagaagtagatgcttcatatcgtttggcaaaaagtcaggcattgagtgtattggatgcccttgcaattgtaaagaacaaagataatgtggagatactcatccctgaagctctactggaatcagatggagatggatccgattacgaggagaacggcggccaagaagaagaagaagcagggctatatcatcaacaaaggttttcccatgtcctttctgcattgcaaaaagataaaattattacaaaattcaagcagttcacagatttggtaataattgaagctaaaaggtctatcgtaaacacaaccgaacgtatccccttgtatatgtatgcactagtggttgcattgggatggggtagaatcattactattctcaggaatcccgctacgatcatcttatcgatcattgttcttgccggagcatattttgttcacaaactaaacttatggggtccattactacaatttgccaaccaagccacaggacaagcaactgcggtattgaaacaaactgttcgaagcttggtagtggatgaggaaccaaagagaaagatactcgtcgaaccacatgagtcagaaggagtagacaaggaaccttcgaaaaatgaccagcatttataattacaatattatgtagtaacacttgctgtatataaatattttaataggattccgagataatatcatcgatatccaaataatgttttagcttccatggttaacttccctgttgaacggtggtgaatagaaccttaaaatactatgaaaaaaacagtcaaatggctttagcattctattgaagggtttaatgaacttttgaaagtgcagcctctaaaagataaaagaattgcaccgcaaggtcctttacggagctgtgtggtcatccattattatgtcaaaccaagaagccaccggaagttggcagtttttacacataaataatgatatttcgttggctaaaattacgaaagagtcatcgtcatccatcatcggtgtactgaagctctgcgaggatgagaagttcttacggtttcgtgtaagctcagagcagattccaaaggaattgggctgttcgaatggagtagattcaattagcgaactttataatatattgacgaaaggagtggagggtagctcaattgtagccatggataaaaagatcataatatccatccagagaaagaaggcttcttcagtggaaattgaaacggcaattatcgcgattaccggcgaacacttaacgcaattactattggaatgtaatacgtatcttatgaggaacgtgttggttttaaattacgttcaaaactatacttctcacactgccttggagaaagacagagcaatagagttcctcgggaatacagccaaggactatggtgctaataatgcaattttgagatgggctccagaaaactccctcaactacagagcgttgatgaaatataaaccagagctagtgcttcaggagagtgctccggataaaataattaattcggatgcagtaaatctttttgaattaaatgattccatgaagaataacggtactataacaataaaaagttttaagaaaagagatgagttgaagaatgaaaacaagagcacctacgatacatgggaatccaacttcagtgaagaagaactggatgatgacagtctattagataaattcgatctcaaagatgatttaaaaatgcaagttgccaggctgaagccagcccaaaaagatgctggttcggattcagacactgatctcgaatacgaaagtcctacaaaacgggcgcgaaccaaataatagaatagaatagtgagctagattaatgtattatgatttgtaaatagaataatgccaataccatgccaatggcagtcttgaatcatcactacggtaaatcaaaagcggagcatttaagaatccagtcattaatgaaacttctcgatgctctcccctcaacgctaaattctttgggataaagatattctataacgttagaccaaaaagtgacaaaggtttttaaatagatcgggttcagcggaatggctgtcagctcatcaggtagatgtttccaatcattttttttgaatggcgatcctttaaaaaactctgagaagacagccgtgtaatgattatgaactgttttccccaccgtaacgaaatcaatcatttcatccttatcatatgatgtaaagctcaaatcttcaccatatatatctatcatagtatggtctacggccttgataacagtggccaaaaactcatggtatgcctgaacggccaattcttggaacatctcaccgaatttttcatgatgttggatgtctctatctgaaatagaatatccaatttgttgtgcatactgtggattaatatcactgccatttttcgctaccttctcctgatacaccttagaggcaattaggttagcagacatccctttgcgataagaaaccgtcaatatttgctctgttaatgcccgaagacaaagattcttgtcattggacaataatatcacaaaattatgtaaagtgtttgcgaaatacaagcaacactcaagtatagcgtcatctttcactaagttatacttatgccgttgattcagtttctggaccgccactgatgactctagattggccaaatgtccataaatccaatcattagcagcccttgccaacttacctaaattttggtaatcactgttagatgatcctgaagctgcggattttccagagtttttcaacccatcaagctcttggataacagtggttggtataaggatctgatggttatactgtgtgctcaacaatcttaattgctctagagtattcaaatgagaaacgataaaattagtatccacgacaaagacacttttctttgtcggattttgggacatagatatctgatccgtcggtgctaaatccaagtccataggttcgttacctcgatattcgtgatgacttctatgatctataatcatatcagagaccaatgacacttccttttcatcatccaaatccatcatatcctcatcatgatattcgttctcattgtattttactggcgttggctctccactaggattctggtaatgtgtattaggttcatctaaccccaagttaggttcatctaaccccaaactcttatgcaaatcattcaatgcatacttttgtgctctttcggtacccttggattttcctctatttgcgctagcatacttagagttcaacatgtgaaatcattgaaaagatccaaatctcagttgagtggtatcgagtaactgttacaatgggcctctagaagcacataaacagtagcgttcagcaagcaattcacttgcattattctcggctgaattctacctatctcagttttttttcagatggcgcaagtaaggttttttggtcgagttttctaggagaaaaagtctaccattccgctgagaagagcacaactgcgaatagaaggatcaaaaggtttgtatattgatataagtacatatatgtatatttaaacctctatatataatactagtttaaacgagatgttgaaacaaagtagtggacgttgaaaatattgtgtttgaaaagtgcatcacaaagaccttatatccagtgtgtgaatgtaggaaaaaatggcaataacatcagaatcaaataaaaatgagacctcaaagtaaaagctctcttcgtgtagcccataaactagcacgacaagcaatctttacaatgacaagcctcattcaaaaaaaatattcttctctttagtaaatgcttccttcaccatgttctgtaatatatcgagaaataataaaaccaagaaaaacacacgacaaacgtacactcactgtttgcatttggccagcgtcgttaaaaacctagcagtatgataattattgatggagtggagtgttaataaagaaacagatagaaaaaaatagtgaacagtaaaatcaatagtacaagcaaatctggtagtgagtttaaccaacagacaatacgagactatgatattcaatttttttgtaacatattcctccttaacgcaaacgacgagcttcacgttcggattccatcaagaccaagatgtcaccttctctgactggacccttgacgtttctgacaatggttctagtagtgtcttccaagaattcaacacgaacttgggtgacaccaccacgagaaccggtacggcctaagaccttgataactttagctagagtaactggggttttggtatccattgttgcttgatggttcttccggtaacaatactaacactaactaaaacaataaatatactattcaattgtacagaagtgatgttgaatgtgctaaatatttcattggaagcttttttttcttcattgaaaagttttcgatgagacacatacaaaaaatgaaaaaaaaactgaaaaaatggaaatgtcgcttgggtaggtttggacaaggtcatattatacggaattcctaaagccaccgtcgctccagtctgacactatgaaggacaaagctaggtgagagtttatatacatgtaaagacttattcatggtctgaactatatttattagctatttaggtgaatgttgaaagtgaggagagacacatgtgaaatatatttaaggccattctgcaaggagattaagaatggaattgtttgtctcttatgagtttaactagtgcttcttctggaagatgtaacatatctttgatttcaccaacgaacccagtaatcttttccacgtcgttctggaaactggactgaagctctttgaacattgttttgtatttctcagataattcgttaataatttttttgttcatctcaccgttaattaacgagatctttcttgtcaattcattactgaagttcatcacggagtgataaatctgttcctgtagttggtttgtaaacgaggtctcaaacgatgggaatttattgctaccacctgaaatagtggtgttttctgcggtagcagtagcagctgcaaacatcgatatgtcagtatgagacgattctgtaattatggatttgtcgttaccgattgtgatatcatcagatcttgtgtcatctgcagaattaactaattcattttctgccgctacagtactaacatttgcaccgtttttcttgttaaagcagggtttttgttcgttacttgtcgtggtgagaggctttttcacattttcttccgcagcgtagacttttctagatgaccttgtgattctcttcaccgatgaagtggtgactggctgtctcttttcaacttcctttatccgtggttctccatgctccgaaagggcaaatatatcttctttctgatcttgtaccttctgcctcttgttcttttcttctgtactctgcagcacgatggcctttcttttgattgatattttattattgttggcggctaacatttttgattttgcaggcggtacatcttgagagggcacatatacaattggcttgaaattattcaatacagtttgcttgcttttatctaccttctttttattgccccttggcaatggcagggcaaatatgtcatctagtatcgatacatctttcttctttgttgtcgtcgccttgaacatatctgtcacttttttaatcttaccgctattccggtcaacattcccaaccttcttattgtgtacagccatagatgtgtcttttgagatgtgtgggatagcacataatcgagcaagagactcatttacaggttcttcaatatcttcttggcaagaagataatggacccattggtgcctttttgttaaaatcttcctttaaaacttccaacgttttcgacgttgccctcactatctttcgcttctgagctatagccaaaggagattgttgatcatgttcaatagaatcatcaaatatagaaagtttcaatttccttggggtctcgggttgttgggatgacgatggtaccatttcgggtactggtggtttctctactgtgtcgtcatgtggtttttcgggagtatcatagtgatcggtaacttgacccatatgaaacgaactattagtattatcaccattttctatcgtcatcaagttatcaccgacacttggttctggctcttgaatagacgattcaatgattccatcatcgtaggacgatggaaatcttaatgaaatataggtctgtacttcactgatcttaggtaatttagtagcattccaaatcaattcactaacggcgggatcgtggctctgaaattggaaagacgttgtcttgttaagagttgctaaccatgctgaatgaggggacaggacacagtgtgaaaacgtgtcagtcaaagtaattttcaatgtgtcccttaaatctctcacgatatctactttctttggattgatttcgaagaaaaggccttctccatcccaaaagtataatgaatggtgtatcacctgcatatatgattgatgcttggataacgtttttattccactcgattttcctgtgatataaacggctttcttgatggaaccgaaatttgtgaaaaagctaccgtacctttttaaaattaactgaataattgcatcttctccatgcttagcacggtgaggataaagttcatctgaaaagaaagattttgttttctcaggttctgtccatagttttggcgccgaggataaagttgctcgtatattatgcttcttggggaaacaattgattatcaattcaattaagtaatttgccagttgaaaactgttcaaggaatccaaaatttcccctaaacgataattgtacacctcccgtaactgtttaataataaatctccgaatgtctgattgctgataaaacaactctaggagtagcattattgctttccagttatgaatattatctcttgaaattccatagttcaacaaacttctggtcaaactttcaagcccatcacttttccttggaactttgatttccttggttgtaggtaccatacgatacaaaaatatgctgttagtacatgaactatcagggacaaactaatgaacttatttcacgaaacatactgccaatttgaaccaccatctatctgatataaacgatctctgatttagaatctgtccaatatgaagaattacttcgagaataccatactctaatgaaaaccgtggtctgattgccacatccacaatttcttcgaataaaataccacattgcttatcgacggataaaccacgattccttgcattgttccaactgtcaacaacatccgtttgagttgttcctggtttctcctgtatataatcaaccaataggttaatcacctccagcatagtttttcaactctggatagtttacgtgactcgataaatggctatagctaatgtatccaataatgttttacatccattattcctgttgtttacctgctaagggtagaaacatttaaccgccgacgtctttttctttggggacccatgccgaaagcgaaagataaatgtttgatcacgtgacggtagggtaacagtaaaggatactatctttctcttcatcctcagattgtgacattgtaacagaagaaaaagtttcgatattgataaaacgaaacgatgagattacaattgataaagtggatttctttcgattgttaataaatcttttatctgtcgatgtactaacgtttattattcatcattttagaattgcttgataggattattacattacagtagtacataccctagatacgaaagatatgtcatctgtagacgagttgaccaatctattttccaagattgggttcgaagaagctaaagtaaaggaaatcttaaagaatgctaaagtatccagctccctagagtccttagtaaacttggcatctgatgatttcccatggaacaagaattctagagctttaattcacacgttagcagcctctttaaagggagctgaagttcctcatttgcaatatatcgttgatggtattggtaagaatgatttgaagactgcattgcagatagatgcagctttgaagtacttgaagaccaagggtgaggatgccactgttgtggacttgaacaaagagtccggtgtcggtattgaagttactgaagatcaagttagaaaccgtgttgctaagtacgttgaggataacaaagataccattttgaaggaaagatacaagttagtgcctggtctatttgccaaaatcaaagctctccccgaattaaaatgggctgaaccacgtttgttcaaaccaatcattgacgaagaaatcttgaaggttttgggtccaaaagatgaaagagatatcgtaaagaaggaaaagaaaccaaaggctgaaaagaaggctaatggcaaagcaagcaaggaccaaacagaagaagatggtccaaagagatctatgttcacagaaggtttcttgggtgacttgcataaggttggagaaaatgagcaggcctacccagaactaatggctgagcatctcaaggctaccggtggtaaagtacacactagattcccaccagaacctaacggatatttacatattggtcattctaaggccattatggttaactttggcttcgctaaataccataacggggtatgttatctaagatttgatgataccaaccctgaagcagaagctccggaatatttcgagagtatcaaaagcatggtatcatggttggggttcaaaccatggaaaactacctattcctctgattacttcgatgagttataccaattagctgaaactttgattaagaacggaaaggcttatgtctgtcactgctctgcagaagaaataaaacgtggccgtggtatcaaagaagatggtacacctggtggtgaaagaaaagcttgtgtctccagagaaagacctattgaggaaagcttaactgagttcagaaagatgagagacggattctacaaaccaggtgaagcaatcttaagaatgaaacaagatttgaactctccatcaccacaaatgtgggatttgattgcttatagggtcttggatgctccacatccaagaactggtgacaaatggaaaatttacccaacatacgacttcactcactgtttagtcgattccttagaaaacattacccactccttgtgtaccacagaattttacttgtctagagaaagttacgaatggctatgtgaccaagtgcacgtcttcagaccagctcaaagagaatatggtagattgaacatcaccggtaccgttctatctaagagaaaaattgctaaacttgttactggtggatacgtcagcggatggaatgatcctcgtttattcacattggaagctatccgtagacgtggtgttccaccgggagccattctatctttcattaacactttgggtgtgaccaccagtaccactaatatccaagtcgtaagattcgaaagtgctattagaaagtacttggaagacactacacccagactcatgttcattttggatccagtggaagtggttgtggacaatgtcgatgaagatttcgttgagctatgtaacatcccatacaggccaaacactccagagttcggtgatagaaccgtcccattcaccaagagattctacatcgaaagaagcgacttctcggaagacgttgacaacaaggagttcttcagattaacacctaaccaatcagttggtttaatcaaagtaccatacaccgtatcctaccaatctttagagaaggatgcgaacgggaagatcactaaaattcatgttaaatatgagaacgaggaagccaaaccaaagaaaccaaagacctacattcaatgggtgccaatctccgaaaagcacgactccccagtaagaattgcggaaactagagtttacaaccaattgttcaagtccgaaaacccatcagcgcacccagatggttacttatctgatattaacccagacagcattatcgtgtacaagagttctgtcgctgaatacaacatcaacagcattataaagaactcgccatgggtcgtggacagtgcaaagaagtctgaattctatgtggaagaagaaaagggaagaaaggaagtctgcagattccaagccatgagagttggttatttcaccttggactctgatagcacagatgaaaagatcgtcttgaacaggatcgtttccttgaaagacggtactaaatgaagagatatctaaatatccgagtttgtcataatgcacttttactccatactctatctatctcatctatctcacctatataagaatataaacgtaataacaagttaatgtaccagatttacttactagtcattaccacttgttgccctctctctatgtcgattggaaatctgccttgaaaattgataatttttgatactgcaaagatgacaaggagaataagatcaacgttgaacaatgtacacttgagtgtggtatacaggttttcgactactgttttcaggaggttactaagatatctgatatatcaaatacatcccgaacgaaataacaatgtcgtctcgtcaaggtggtaaattaaagcctctaaagcaaaagaagaagcaaaaccaagatgttgatccagaggaagaagcctacaaggaaaagcaaaaggccgatgctgctgccaagaaagccatgatggccaatattaaagctggtaaaccattagtcggtggtggtatcaaaaagtccaagaaatagctcatttactcgctatatccgtgatgtttgaacatattctatttggaagaaatatcagatcgtgcaagagagaataaatacacctacacttgtatattcgatatataatcgccaaatttcaatataatatatatttcttcacaatccacacttttactaaggatcagggtcaacacaagtatatattgctctatatatcttccttctcatggtccattttatgagcatttacccattattattggtagatcgtttagtacggtactttatttatgtaaagaagatccaaattgagttttgtgtgaagcgagcacctcaagaatttggttgaatttttcagttaatcgatgagccttgatcagcagagaacttaaatttaatgaatcactaaccgtaccctggcattacttcggaacaagatattgcaatacatttgttacttcaagctactattgtcgttatttattattactttataggcgcagttacgagataccatagtagagcagtctgaataaacggtgcaaagggacccatcgaaatagatttacgtataacaatgagtgaggcagcaggcaaaactttaaggaaatataaaattgtttttctcggagaacaaggtgttgggaaaacttcattgatcacaaggtttatgtacgatacattcgatgataattatcaggcaactatcggtattgatttcctatcgaaaacaatgtatttggacgataaaaccattagattacagttatgggatactgctgggcaggaaaggttcaggtccttgatcccatcgtacatacgtgattcgcatgtagcaattgtggtgtacgatgtgactaataggaaatcttttgaatacattgacaaatggattgaagatgtcaagatggaacgtggtgaggaaaatgtaatattggttatcgttggtaacaagagtgaccttgtagaagaaagacaagtatcgactgaagaaggtgaacggaaatcaactgtactaaatgccaaattgtttatagaaacttcaacaaaggcaggatttaatgttaaaacactattcaagaagatcgcaaagcttcttcctgagttccaagacgcacagtctactccccttgataatgacactaacgataagaagcccggtgtcatcaacctcgccgcaccagatgaatcccaacagtcaaacggatgctgttgaggcatcgtatacataaaaagatcaagatctttaacagtacataccatgaattttaatgaatagtcagtcattaataacataagcaaaaagggtacaattatgaaagatcaagcagcatataggatacattggaatataataaaaatggggttactgttattttcctaacagtagccagtattttaatctgcagacgaagggaaagattggaaaaattcatttgttttattaaaagtatcaggagtcaatccaagaaaaacctcctactctgctgaagttgaaattgagatgaacccagtatcttttactgaaagtattgaattaatttagtccgtttattacatggactcaaagtcggtttctacgtaactaccgtttttcaacaaggtttttacaagtttaggaagaacttctacttgcaatgtctcgtacgggaaattttctccatcaacagaaataacgctattctttgcatatgggactaacctgaaagccaaaattttagaatgttccacttcaggctgtaagacatgtgaccctctattcaatgacattaaaattggggcaattctcgttaatggcgtacgtccgtctgttagaacgaaatccatggtaccgtcatccggcaaggcagctgggaagaattttgtatcaggcgcaatgtaaggcatcttaccagtatagaaaatccctgtgttacgcgttagttcaggatcaattctttcccaatctgacggtacgtcatcttcaaacggccatctgagtttgaaggagtcatcggtaattgttatatcgtccaagtttgactctttaccagatctagggatatcgagtgtaaacgtagaactagattctaaatcattccgtagattattcaatctatccttatgttgcaaataatgatcttttagttcatttttcgtcttggcagcgtatttgaaatatatgtcacacggatatttctttctttgtaaaacattcatagtgacaccaagttcaaaccttgctggtccaataaatctgatgaactccgtatcaatatcagattctgcgatgattccatacgtttgacttaagaatgacaatctaggttgatttttataggacggttgagtacaacacatgacatctattctcgattcgacagatttaaggagagccaatgcggcatacgatggattactggtaccatggcaagatatactcattgcattacctgaaccacaaggtaattgagtaatggctagcttctggaatgctttagcacgatctgatcttaaaaacaaaccattcataatttcgtgggggataccatcaccagaagcacatgcaactacgtcgtattcatctatatccaaattttttgcaatgtcgacagcatgcaaatgatatgttgtctctttaacaacgattttgcaaccacttgctaataatattggtttggctttggacaagaacaatttattggctttacccttaccaccgtgtgggttgataatgactagaattgatttgtttctcttagtgtttttataacttctattcaagatctcttctgccacatcagttcccatattaggaaacactgaagtatcgacgctcaattttattgtttttgggactaaatggttcctccttggctttgcaaaagtgacttcaatcaatgcagtatgatccggccatggggaaccatcatcttctgcttccatattcgtgacatcaagaatctttgcgtaaggaataaccgtatttgaaggtagcagcagagcttcattctcatctttagattccgtgtcgctgagacaagtaacacaactgattaacgaagctgtttcaaaaacactagattggaagctcccagaagcatcgccgtcttcgtcatcctcgtcatcgccgaaatcacctccattacttctgcgtgccaaaagcgtcgatgagcttgttgaaggaccggacgtaaattgatctttaatcaataaaccattttcgccaatgatggctcttgtatagggcaaatgatacttcctgctcagcttactcattattcttgcagccctctgtttcctttttctcagatgaagggaaatatctgaatcagactctgatctctgtttggaccacaacagttttggcaactcaacaagaataattaactacctcttttccacctttacgtgaaaataacgcaaaacaaaatcaaaaaaaaagagactgattcaaaattgagatacagtcaaacaagatcaatgactatgtcttctgttattctctgatgaatcctcttatcaatacctagctaataaatcacagggggtatgttttcgggatgacggatatattactgttcctttcagttcagttcgatttaatttgatatatctaacttgaaaacggagaacaccaaatcgttgtcataaatatgataaatggaaacgtttcttggaaatgataataaagtatagtactatccaccagttaaactagaattctcacagacaaattctctaaacaaatttcctaggttcacgatgcttatataagaaccgatgcgcaatgctttttttatcagactgtcttcttgtctagataacaaaccacgagagtagatccttagaacaattttcttaaatagtagaggcttgattaacaatactctggctgatattggatgtggacagaacagtttcttattcatcaatcatatctttacgttttaacttcgaaggcttcctgattttcgatttcatgtaaatctaagaaatacaaaacaaaagaaacatcagttggcacgtgatatataatcaattattacccggatattgttcttatatgaatgttaacttaaaaagattctaagcatcgttaaagactaacggccatactaatgaattaagaaatctgctgtcgactagaaagaatgaatatgtaattatgtatgttcgtaacgattcattgtgaggcaaaataatactagttactagacaccagtcagatatttgcgataacaagtttgcaatttagagaatacatatatatatcgaaacggtgaaatactcttaagttggtttctaactaaacacagtcaaagtatgcatgacccacagaaggatcctcgtactaggaaaagcaggcatgaactgaccccgcacaatctttcatctaccatacgttttactgacatacctgctcagtggaacaaggataacttcacatctgtgataactggttctggatatatagttgacgttagagagaaatacgtggatgaggtcgaagaagcaggagaacgagaagggggaaaaggaactggagctggagctggagctggaagtgaaagaggatgtcttgaatgggtagatgtagatttcagggactcttcctccgccaatagggcccaaaattcaataaataagataaaccatttcccatgtaggatgtccatggtgattcccaaagattggaaagaaaagttagagaaaatagaccaactgaaaccgttagagttcacaagagacaattttccctgggattacaaattagaactaccgtttgaaatggtaagtgaggtacctttaccaagaaagccgttgccggtggtgcaaccaataacaagtgacgcaggaagcacactatcctcggagaataacactgcatctacgaatgctgcctcggataaccttgcctcgaaggcgaacgaggcaccggcacagcagatagagatcccagagatcttagcacgggcatcaaagcatctaccagcataccaaccgggctcgatgactgcaccggatgtggtatctcaaaatctatcgaagattcctacgttacaaatgatcgagattctatcaaacttgaagatcttagccaaccagcataacaagaagccacaactggaacaattcttgaagactaacattgacttaacggtagctgtcactcaggcaatgctagaaatggggttgataaactatcacgtgatatcaaatgttctaggccaaatgcagggccaacattctgttggacccacgcctgccgcagccgcgcctacagtaccaactctgccgccagttcaactacctgagccgtctgtaccccagacggctcaaggcattaacagcggtggtaacggtactggtggtgatattaccaccaccgctacaaccaacgctgccaacaccccacagcagttcaacgaggcaaaactttcgctactgccgcaagatcaacagaacatgatcagaactgcgctttcgatgcccataacgaacataatggctcttccaccaggccagcaacaactaatacagcaactcaaaaacgactaccttctatagataataataatagcaataacaagaaaaatacatagcacaattcctatctcttagtcatccataatggctcgaaggctttctttctatctatagtgtataccaccgtgtttcccaacctaaaagttccgcgcgcaagttttcctctttaacgacttggctcatacaggaaactgaaaatggaaaaagctgaaataaccgacatttcaaaacaggaagatgtcaaatgcatgcggcgaaatgaagggaaacgaacgtcgagggaaatgtctaaggaaagcgcaaagggaaagaaatgccgaaacgattgggctactattcgaatgttttggcggtagctgccgccctccacagcaacacggagcactttgtgtcaggatcctttggagagattagatagatatttgtttatgtgcgtgtgtaaaaagaaaaacttgtcaagtcctctcttgcagtaatccgtttctgttttcagtatgttatatcaggtatcatcagtgccgatctgagctgataaggaaggaaggaggaaaggagggaaggaggaagagagggcagaagaggtttccgtcgcagtttcaccgacctattcgttaaaatacctattcgctgctcttaattttttgaatggcgcgcggataattactacagcgtaaaacactgtgcttattgagcttagagatcaatgaaaaaaaagtgcttatgaaattaaagcaaggcgattcttaaagggagcgcgggactatacagatgaggtgcacatgaatcatgggaaaaaaaatcgtatataaatccatgggtagattgttctctctgaactagaggaaccagtttctataatttacatgttgtttgtaattgtgtttttagtttacacccagtccacaagcacagagtaatcatttgaattaggaaaagatgtccgttgctgctaagtactacccaaacgaaccaactgaaccaaaggtcgttacctcagagattccaggtcctgagtccaaggctaaggtcgcttctctaggagaagttttcgattctagaccagcttatttcgttgctgattatgccaagtcttctggtaactacatcgttgacgttgacggtaataaattcttggatgtttacgcccaaatttcttccattgctctaggttacaacaacccagctttgattgaagctgccaagtccgacaaaatgattagagctttggttgacagaccagctttgggtaactttccaggtgctgatttggaagatatcttgaagcaattattgaaatttgctccaaagggtcaaaataaaatttggtccggtctttctggtgccgatgccaatgaattggcattcaaggccgctttcatgtactaccgtcaactacaaagaggtggtcacggtattgacttctctgaagaagaaaacagctccgttatggaaaacacttctccaggttcaccgcaattggctgtcctttctttcaagaaagctttccatggtagattgtttgcttctggttcatctacttgttccaagccaatccacaagttggatttcccagctttcaactggcctcatggtgaatacccagtttacaaatacccattgtccgaaaatgaggaagaaaataagaaggaagatgaccgttgtttggccatcgttgaagatttgatcaagagttggccaactccagtcgctgctttgatcatcgaacctattcaatccgaaggtggtgacaaccacgcctccaaatacttcttgcaaagcttgagagatttgacctccaaatacaacgtcgtttacatcattgatgaagttcaaactggtgtcggtgctactggtaagttctggtgccacgaatgggctgacattcaaccaccagttgatttggtcactttctccaagaagttccaatccgctggttactggttccacgatgacagattcattcctaataaggcttacagacaattcaacacctggtgtggtgatccagctagaatgattattgctggtgccattggtcaagaaatcgtagacaacaacttggtagatcaatgtgctcgtgtcggtgattacttgttcgaaaagttggaaaaattgcaagcaaaatacccaaccagattgatcaacttgagaggtaagaaccgtggtacatttatcgcttttgatttggaaacttcggctgaaagagaccagctattgaagctcttgaagagcaatggctgcaacgtcggtggttgtgctgaaaagtctgttagactaagaccatccttaactttcgaagaaaagcatgctgacatctttgtcgatgctttggaaaagtctattggccaactataaaatactgttctttcagttcctcatcagaacatgtatcaaaccccacacgattagtgtattcttacgtaaatagaagttatttataagaacgcctcataattatataaaatgtgactataattattatgacagaacggattttgcttcatacaaatacatggcagtttttcaacgagccaaagcttctttgacattcaagtatgcatgaaccttatttttctaatggacaagtttttcactgataaagtcaaagtgaaaaaatgaaaaccaattatgatggatcgtaagcagttccaacaacatgaagagaggaaagttcagtatggcaatacgataaaaatacagctcttactaatagatagataaaaacgagaatcatcaattagaaaactaatatgactgcataccctgatgttgcggcctgggatcttgactacacagtctggccttgtttttgcgatacacatatcagtcctccattaaggcccgaaacaaatgtggatggcgaagtgctggagctggtcgattcgcatggctataaagtgtcgttatataaggagataccacggataataaatgatttaaaggcgcataatgtaaaactgctcagtgcatctcgtacgtgggctcctgaaattgccattgagatgttgaagctcttcaaaattaagatgaacggtgaaatagtcagtctttactccgtttttgacgactttaactggggggaccatccaaagattaaccatattaggagtggtattaagaccgtgtatggcaaggacagtctaaatcaactgaaagtatgtttatttgacgacgagagtcgcaatagggatgtcgaaaaatatggtataaaatatctacatgttaaggatcctgttgaaggaccttcttggaagatgtataaaaattatctagaaagtctagatagctgataatatatttaaggtaaggacgttacatgttattaccggcttattaaaggccaagcattttgaaatccaagttgccgaatataatagtcgacaagcaaaaaagaatgccacctccaggaatcgaacctgggtttcatcggccacaacgatgtgtaataacccctatactaagatggccgaattcattgaaagttgaagttaggtcgccattatactgtataactgtcatcagctatcttagttactatgctctttgcgtagcttgtcttttatcatcataaccagaataagatcgtcgaatatggacttctcctcacctatagcagttgcactcatgaagtgaaagttactctttcaaacggcgcagtcacgtgaaggagtgtcctcaaagaagggacgcaaaattgcggtaccttcgtatttaccggccgagatgatcctttttcatacgattgcaaatattccaaaataaatgcacaatttcaggaacgtgataacctgttgaacgatgtgatcggttggttttcacgttactttggtacgttggatcaacgctaaaccaaaaagtaaacctggcctgctcgctccctatgcaacaacagcctattgcaaaggtaaatccttaatgaaagcaagttttgaaacactaggcgcgatgcctggcatttacaagaatgaattctttcccttatttactctcttacgttgagcgttttcggatattgtcttcgaaaccattggtatgattttcataaccttgttaaactgcagatcaagcgaaaatctcaaacaatgtacaaaaaatgtacaacaatgaggcagcgagatgaaaggaagtttgacgaatattcttggtggaaaacttcttccagcattttacatcaaatcaatgacggtttcgattctcgcatatgtttcgtaaattttactccgtactttctttggcagtaccaaagagacgcgatgttatgaaactaaaacttgaaaaaaaaaaaaaagaaaggatgcatacttcatattaaagaaaaccatgagctttgagaatgtagttcaatgtactgcaagagctttacatcattgaaaaggattgtcatcagttgtcataggggaaatgatagcaaaaaatcctagtaacgaagagagaagcttgtttggaggtgcgaaaggcgccactcgagtgggatgtaagagggaacaacccgagtgttttacattagagaaaacagtttatacgcagatgatgaatttatgatggatggtagttgctgttattgcagaattcgatcttcgtgccgcctttcatttggtccgatggctacaactaattaaattaaaacacagctcacacagttctctttgtgggaagttaatccgaaacagagaatattccgtcgattgcccctttggattgtcgacttagggtaacaagggaagaacaatggcattcggaatttcgataaagatgcgggttccgttaattcttaatgccgtttgaagcacactacctgaatcttcttgagaatattgtattataattagaaggaaagagaaatgcacgatttcatccctctttgtttcactacagaattgtatagagccagcaactgttaaaagtgggaagcaggtttggagtatatacagaaaatgttcgataaagagcggccttctaacaattttataaccttttcacttcgtcaccgtaccgccacgcaaccagaaaaattatgtagtgaaagaaaggtccagcccaaggtttcactccattttcttcccattgggaatgagtctctggtcaaggccactttgcattcacagtattgattcccccgcgatctgacggaggaaagattgtcgagaaacgtggaaccttccaattttaaaaaaaacacttccgttcacacgtttctcgtgcattatgacacagctgcggtcatttctgggtggcgctgtttttgttcactacttcgtgattaccttgtgcaattttactatgctctaagaccggaattgtggaaatctatccatacccgattgtccaatccattgaccattgttttctgagcaaatccgcagcattgtcggtaatggcttaatttgcctgttgcagaaatattgtctcaattttactggccaatttcttgtgggatccctaatcaagtaatggattgttaaggttgcggtgtaaatgcgtgccttcatttcttgttgcttgtcttggtttttttttattatttgttcggattccagctgtacgagttctctttgttatggaaaataacaaagtacatgtccataggtacagatagaacctagatttcgtgtccagtttcaactctaacagtgaaaagttcgttcaagaattatggaagcgcgccccctagctgaggtacaaaaaaagaaaaacatattagtgccttcagtcagaaaggtgtgcagccagacaattaaatgtttcaaggaacaatggtatcaataaatacaatgccatccgctttcagattattatgcacaaattcttgtcatacgtatttaccaggcgcttttattcttatttcacagaatcgaatttcaaacaacgctaagtttctgattacggatgcaaagctctccctgctgtactgcacttgtatctagactatctattgatcttggacttgtcacaaatgttcttcgggatgcacgtacggaatggtttcacgtttgtgttttgaagattttaatgcttgttattcagtggatttctttcactgtgatgaatgtttgataaagaagacacgagatagaacacttacagcactgcataagcatacaaacaaagtagcagacagaacttatgaatagtgttggactgtctagatgaggctgaagataatatatttcttttcagatatgagacgtactcatttttttccatgcttaatgaaacccaccattaaagtggatttcatgggaaagtttcgaccttggcttcttgcttgaaacgtagtacggtaaggatcgaatcgtctttcacatttgtgtgctttaattatgagagatttctggaaaagggtggcattcatcaatatgaagtccaatcaaggatgagaaaaatgttggcaaaaatagaatttattagaaacggtaacagcagtatctaacgtgtaccttttggtactcaggcttcttttgttgctggtgtctatgggctttcgcttcaaccctaataaacttttgctagtttacaagtctattttccttcaacctcacgtacaagcagcgtacacacatattactgtttcttttctaatccgctctagcgagtgttatgcactggattatcaatttttccgtctatcatttgccagtctttatctagccagttggctatccattaatcccttctacgtgcaacagtttaaagtggagagcatttccgcactttttaccggttgttcgtgtgatggtgaagtttctgttgccctctctccttgcgagaacacctcaaaaagctcgaaggcatatacatgtatcgtagatcgttctcattctgttgtttcttctctttccaggttttggtacagactatttgcaaactaaataaaattccaagccttcttgcaagaaagatctaccggagtttacacagttgttactctgttatgagttttgttctcttgtttcatttcaaaaatgcaaaccgctgccgtactgaccaacggtttatcaatgctattggggggggacactttttcaattatcttgatttgcaacggaagatccaacatcgtacaatccgtgcgcacggtacatgcaaaaagaaaaaaaagaaagataattatagctagagaaaatccagacgaggtattcgtaatttgctaaatatcaggtagaatgtctttatttagtacacagcagccagaaataagacatctgaaatccgttttaacagaatggctctgcagttgcaacttttctatatcggggtttaaaaaatggagtttgacttgcaaaggtaaagtactttccaaattacagatgaactcgatgcgtattagaggagccttatcagtgttgatcttaaaataatgttgtcgagccgttaaactgtggaagtattttgtgaattaaacgataatgatacataccaacggatgcatacccccgatatttcaattaatatcttttaggtgatatgatctcttaggtggaagcggagatataaatcaaaaactaataactaggtagagagcaaacgtaattaggcgaagaaaacagcctgtatatgttgaaggaaaagaaaagaattaatgcggtttcaattttgccattagtgcttgctgcaaagatcggaagagaatgataacatgctggagccataaacaaagaaaactggtgaagtgcacagtttgaattttgtaagggctagaattgaattagtgggagtccgactgaggtgaacccgtcaaacagagatgagaattacttgtgaagcttcagatgccttatgagattactcttaacattgaattttttgttgcagccttcccatgtgcattcgaaaggcttatcgccagaatgtaccaacatatgcgtacgcagagcgctaggtcttgtgaattgtttcccgcactgtgcgcaaatatctgccttcccattagctttaccctttacaactgtggttggactattgtgatgacgttgagcgtagcttatatgttgttttccacttttttgggaatgaggacgtgatcgattatcacatgtgttacgatgatgcagaggtggatgatagtacgagtttgtagatccaacggcaggccttatcatattattattcgtagcaactgtaattccactttggctaagcatagaacttgtacctgtgggttgatgatagatttgaggagcaacatgcatcgaattagtgcccagggaatgaacatggccagctgaaattccattcatctcaagtcccattcctgaaacgacattacttcccctccgaggtttgctttgagaaccgaatgacaagccatctaacgaggaagagctgctcaaagcgtaaacaacactgctgctgctgctgctgctgctactactactgctgctgtcgacattactttcaatggaaagacccgtagtggtatatctttgtgatgagccagagtaacgttccggagagcttaattggttgaatttggagtaaggcaccgatgcattgggatatgtggttgcagtgagcatatatggatggattgtttggctgttgaagtattgcggtggtaacagcgttgatattggtggtaaaaccaaattagattgccttgtgttagtcattattggttctaaggaattgatcgaagtcaaattgaaggacaatgaattgaagggcagaaattaaaagacgtgaaaaatgtagctaatgcgtaattgaactttgcctatctgtaattgagattaaatatccgatgtttatattactcttcgccctttttttatagtgaattgatctaaatgccaggagaagtatacttgttggatattgagttcaatctgtgaaatgaaaagatcttagtaaacaacagttttcaacttaatacattcaatgtgaaccttggcgctgtccaaaaaaaggatactaaccgaaaagtgattttggaaattgttatagttaatgaagcctaagatctaccaaaaaatattcagcctgtttatatcggagagtaaagtggattagattagcgactgtataaagttaacgaaaaatacttcgtagtaagaaatggaaatattgacatctcccatacctcaactacttagaaagcttattaagtcttgtcaggttctttgatatatgatcgctgataaagtttggtattcacagaggaacggaatacccaaaaaaaactggtagaaatcaatcgagtatatcgagatttctttttttgacatcttcaatgtctccaatataataacagattcttcagtaaactatgacaaagccaacctgcggaagcggagcttgatagagtttcctttgataaatgaaaaaggaaaaaattactttgacaaagcagtacaaaaccacgggaagctttttggcatgtacggatcgttagcatcaaagataacccaggagtagaaaggtgcctataagctacctagaactgggttctcttgaagagataacggaaacactggttctgcactaaaatctgcagggatgaaaaggaggacgggaattcttgcataatacaaacccagtttgtcaaaaaaaaaattaagtgcttttttcttttcgagtgggaaaattttcagtgagactaggaatgttgtttgttgtattgcaatgatcaagagaaaaatgacattctttgtcgtatgtcatataattggaatggatggagaaaggaaggaaatacacccagtagaatgactggcgcataatttctatgagcaatagtacaagatattctgtatataggtatgtagatgacaaatgttttcccgaagctggaagataagacggaacaataaatgccatacaagacaaaaaaatcactgatgcggaagcattaactatctgcacagaatcaatggtacttgcatgaagataatagtgccattacgacgcatccacgtaactaaatcagatattctgatcaggtaaggcctaaaaccaccgatgataagtccaccaaacacattcagttttcggaatatttgggaagtttcgaccctctgtcattatgtgtctagaaatagaatctcttgtatctctgagcctactttgaatgacgacacggaaaaatcgactgaagatgtttcgtcatacgcaaacgaaaaactgtaaagtgggtttaacgcaccacgaattctcatatgagggactgaaaccctttccgtagcgaatcacactttgttcctttattcctagttaatcaataccccaccataaaccaaatccaagaaatcttattcctttgtaatgtctttttcagtgttagtaagaattgcatcaacatgctatagggtatttactgtacagaataccgtgctggcacaagctgtctccattacgaactgtcgaaagtaatatctccttatcggggttccattaggacgccaaaaatgaatgcaagaaaaattagaatagtgcctgaaaaccaaaggatgaatatttgattttcttggtatccaatcgcttcaataacaagctattgatctgcgaagatatttcccacggaatatctagggttggattattggtttttatccggaataaaaccttagtttggcattaacagaatattcaaaaaaatgaaaccaggaaacatacactacaaggggcaacatggttaaccatgataaccagggcaacaatggactggcaaaattgttgaatgctggccaaacttgttctttacattcgaagatcaaccttgaatatgactgctcggaaggggagaatcggataattataagagttaaattgacatgatagcaatgttttgaatgtggagagagtaaaacacggggctggatgagtatataacttggtagataccttctctctacgacttttacataggagtccttctttttgatagttctttacatattcacgtagaacatctcgcagcaatgctcattttaatgagtcaactgcggcttttaagtccttatccaccgcgagagcttcattctaaaatgtaccacctgaagtggtactaaaagctgacctaaggaattactactgaaagaagtataggttttgaatccagcacgtgaggaggctttccgcttttagcttggttagctttacggttcatttaagcctcccacttccctacattcaaacatgcaatcttaccggaaaatcaggtcctattctctaggtggggtgaattcgtccaatccttatttttaactttctttttcttcctctcaatgcggtcgagccacaattaaagtaagtcacgagtgttgatatctgacaggacagtatatctcttacccggaatttgttttaccacgtgttgtggctttttaattaccctgtggcactttatcttgttaccccagcaacacgggttgatcttcccatcaacaatgaacttttttgcccccaagttggctgcaatatttggcttttcctcttagaaaatcaggtacaacactcgagaacctttcgtaacgtgccttttttccggttttgagataacgcattgtctacgtaattccattagagtatagatatcgccatgtgtgtactattaccatatacttaaaggtacgtggatctctaaacacatcatattctcttaccccactttcgcttccagtttcttatgatttcgaggctgagtcaaaaattcttctggaaaaaaagaaactgagtcgttagtcagcccctgtgatatgaaatgttttcctagaaacccccgttaatcacatgacgatcgtgggcggtgctgtgtgggttacttttctgctctgcccttctacgcccttgtaacagcccatgcgggataccagagacgaccctgttcgagtcccagtaaagtgtcaactttgataattagcaatcgtatgtagtgctgaccaagaacaaaacgtgggaccctttacagataaaaataaccgtagccatatcattattcgcaaaggaaagagggaaggtattgtgctgagaacaccttgtggcctgtgaggcatcattatcgccgattctcgtccaactgacacttatacttcctagaaacgccagcaattacttgtaattacataggttatggataaatgtcttttctcagccttttacagctgtaaaaccttgatcacattatcgtaattatcgtctcagtaaagtcagtggtcattttagataccataggcaatgccttttctttttctgataagtgaatgatatgattaacccgttctaatttccagacacatatatatataagggtccttgatggaattgagcatccttacacaacatcctttctcaaacatatatggtttcaagtcataaagaatactaatacatttcaatttgaatgtttgttaatttgtttcgtatcttacagtacatatatctttaatacaaactaaacacaaagttcagttataaagttattactcttgttcagccttgttataaagaatacaatcgctaagcaaggtgttaaagaaaaatacagaaattgttcacattactaccgctgaaattcagattgatatacgatcaaactatccatctgattacaaacacagataaaaacaagttttttgaagctgacccaattccttttttgcgttaaagttaacaagtttaaaggaataacaggaccccttctttactcccattttattgatttccagtttatttttcctttgcttcctagacaacaaaaattgtgacaaagagcaattgaaaaaaaaaaaaaaaaggcagaacactttgaccagaaggctataaacgtatttctaaattcttactcgagagcctctttttgcgatatatctcaataagaatctcagatacaaagttaagaatacttgccgttttattgagcaatactgatttcatttaaacagctcacttcttgctttttactgttcttctattgcaaacaatttctccctaattgttaagcaggatagaaatttatcaatagaatacaatcaagaaatcattcaggcgctaaagtcaagaaaacagaaacttttcacattctccgttagtttacgttttattagaactgataactaaaatacagttctgataagatagaagaaattaagcgttgatacaactactttcaaagtgattaccttacaaagcatactaagtcacatacaaatacacgatgggaacaaagattaaggagattccagctgactctccatacgctagaaatgatttccacgttttaaccgctcctcaagtggaaaaactattatccacacacatcaaccagggtttaaacaacacgcaaatagctgaaagactgagccttgttggtgaaaatacccttggtgatgatacaaaaatcaatattaagggtattctaatcagtcaaatctgtaatgccatgatcatggtgttgatcatatcgatggttatcactctcgccattaaagactggatctctggtggtgttcttgcctttgtcgttgggatcaacgtcgtcatcggtgcatatcaagaatataatgcttctaagacaatgaactcgttgaaatcgctatccactccatctgctcacgttatcagagatggtaatgacatcaccattcaatcaaaggaattagtgccgggtgatatttgtatcattaaggtcggtgacaccgtgccggcagatttgagactcttggaatcaattaatttggaaacagatgaagccttattaactggtgaatcgcttccagtcgccaagtctcattctgaagtttacgagaaagatacccctgttggtgatcgtttaaaccttgcctttgcagcatctactgttaccaagggtagagctactggtattgttataaagaccgctttgaacactgaaattggtaagattgcaaagtcattgaaatcagaaacttcattcatctcaaaggatgaaaacaaatcatttggacaaaatttgtggatcacattgaaagagactatcggttctttccttggtactaatgtcggaactccattacaccgtaaattgtctcaattggctattttattgttcgtcgttgccgttatcttcgccattgtcgttatgggtactcaaaaatatagggtcaacaagcaagttgcgatctatgccatttgtgttgctatttctatgattccatcttcgttggttgtcgtcttgacgatcaccatgtcagcaggtgctaaagttatggctacgagaaatgttattgttcgtaaattggattctttggaagctttaggcgctgtcaacgatatctgttccgataagacaggtactttgacacaaggtaaaatgatcgctaaacaagtttggattccacaatttggtactattactgtccaagaatccaatgagcctttcaatccaaccatcggcgaaattcatttaattcctaaattctcaccataccaatataaacatgatgatgaagaagatgttggcattatcccagacttcaaatccaagtatttggctggtgaattgggtccacttaatgtttctctatttgaccaatggctctacactgctactttagctaacatcgccacagtgttccaagactctgaaactcaagattggaaggcacacggtgaccctactgaaatcgctatccaagtctttgcaactagaatggacttacctagacatgttttaaccggtgaggacaaagatgatgaaaaggatgcccgtgctaacagctcctttgaacatgtggctgaattcccattcgattccagtgtgaagagaatgtctgccatctataagaataccgaggatccagcaaccccaatttatgaagtgttcaccaaaggtgcatttgaaagagtgttgcaatgttgtgactcctggtataccacacctgatggcaaaccatcgcctttgagtaaggaagatttggaaaccattcaaaagaacgttgacaccctgtctagtgaagggttaagagtgttagcctttgctaagaaaagttttaacgaatcggaattcaacgccaacaaggataaactattgaaggaacgtgactttgtcgaatgtaaattaacatttttagggttgatcggtatttatgatccaccaagacaagaatcacttgccgctgttaaaaaatgtcatcaagctggaatcaatgtgcatatgttaacaggtgacttccctggtactgccaagtccattgctcaagaagttggtatcttacctcataacttataccattatccaaaggaagtggtaaatttcatggttatggccgcaactgatttcgatgctttaagtgatcaagaaattgatgatttacgtgttttgcctttagtcattgctcgttgtgccccacagaccaaggtccgtatgattgaggcattacatcgtagaagcaagttctgtgccatgacaggtgatggtgttaacgattcaccatcattgaaaattgctaacgttggtattgctatgggtattaatggttctgatgttgccaaggatgcatctgacatcgttttgagtgacgataactttgcatctattttgaacgctgttgaagaaggtagaagaatgagtgataatatccaaaaattcgtcttacaacttttggcagagaatgtggcacaagctttatacttgatggttggtttatgtttcgttgataaagaaggtttctctgtgttcccattgtcacctgtcgaagtgttgtggattattgtcgttacctcatgtttcccagctatgggtcttggtttagagaaggccagtgttgacgttatggaaaagccaccaaaggatgccaaggctgttgttttcacctgggaagtcattattgatatgcttgtatacggtgtcatcatggcagcatgttgtatggcatgtttcgttaccgtgctctatggtaccggtgatggtaacttgggttctgactgtaacgatgcacttggtgaaacgtgtcacttggttttcagaggccgtgctgcagcatttgcaacaatgacttggtgtgcattgattttagcctgggaagttgtcgacatgagaagatcattcttcatgatgaaccctgaaagtgaaacaccatacactcaagtgttcaaggacatctggagcaatcaattcttgttttggtccattgttggtgggttctgttccgtgttcccagtggtttatatcccagtaatcaacgacaaagtgttcttacattacaatatcagttacgaatggggattcgcaatcggatttagtttcgcattctgggcaggcgttgaattatacaaatatggtaagagacattacttcggcatcaaggacagagtcgacaatccagaaaatgatttagaaaagagagcagtgcacgatccgttcgaacaatacactacttccttctccagaatgaatacttttcacaacgacgagaagactatctgaaagttgaaaagatgcaggaataagcggtgctttttaattatttttaatctacaacttatctggaacaaatgtatattagcaaatccatatgataagtatcatcaataatttaatttttataaataccatactacattaacaaaagtagtttatctcactttagatcgattttactctagtttcccgtcaaaactctttatatttggcctgaatcgattaagactttgggcccaaaagttactaagccggaacaactgattatgaccgggtaatacatggtctttactcttttcaaatctttttctccctttccagcgtgtaaaatagtttcaagacaattttcgtcaagcgatacgcccaatggataagaaaagtcaaaaacagtcaaaaattattcccacgggtaattaaagaaacccaccatcttagcgggctacatatgtaatcagctactgtataacagcagtgcaccttacaaacttcagatatcctactaaaaacaaaaaaccgagaagcaaagcaaggtcaatgagcttgcttagatggctagtaccattgccgttcccttttttcttcccttttctcccttctgattcgttttctgcgcttgttttcctgtagtttttcgctcaaaaaaaggcaaaaaaacgcctaattgaatctcgttcgaaaatcacatccaaggcgttgtttatttatttatataaatcgaattttacaaatgtttgatttctcttacttgttttagtttattgtaatatactctactttatttttttattctttatgaatgcttacattcattgaaaccgcgatcctctatgaattgacaggcttctggttcaatctctcttactaattacgaacccgctcattccgtagctcctggcttaatacctgattgtgtttagtttcaagagtcttataagggggtgaggagagaatcggtttttttttaactcaagagtaacacaaactcttggcgctaagcgctggcctgaaacttagactgaagttttcttcaaatataaaagaaccttcggaatagatggttcgtcagaaaagtcaaattgagcggcgtgctgtgaactctgttcgtttatcctcctcttctccgttatcttccaaaatgcatgtgccggagaaaagtaccccgccaagttaccctgacgaacattcaaaaacaaacgccgcccaagtggagctaaccgcccagcgggaagtgaccaaaattgatgaaaaacaagaaaacgaaaaacaacaacgagtgaaaacaggtgaaaaacaaacgctgctgcgacatacaccaaggctcaaccccttgatacatttagcgatgtctcctactgctgctccgaataatacgcctgtggaggaaaacgatctacaacagggtgttatctctccttcacgtggagagccttccgggattccagggacaaagcctcaaaccgaggttttgccgccacttcctcgttacggagagactaagcaagaggaaaaggaggttgccgtgaaatttgagaaaaaaacgggtacccaagactttgatcacgtggtttcggctgataaacaacatgttccaaaaataaatacgcgtacaccatctatctgtatatccagtagcaatacgctgccgaacactgggaaagggagtagcaccttatatcaagactcgcgcactcccgtgtatttgttcaacgataggatagactctggtcaagtgagtgaaacagaaacacttcacgattcaagaaagggcgaggaaattcaagctgatactggtagtcatcaaaatgaacgcatgctgcgacaaagcggacatagactcgaaggcaaaaagggcaatggcagaaacattggtaatcctggaactgtttcacatgacggtgcgagcggtattgctgcgccttcatcttcgccgatccttgagacctcgagcgcttcccgtgatagagatctgcatgccacaggaagcgccatgactccaaaaagactacattttgattgttccacagagaaaatagatccgggtgcaggcatctcatcaatttcagctcaaaagatcaatattacttcattactaaactcgagatcgacagcagaatcaatctcgccccctccatctacggcaggaaatgaatacactattcatttcccatcctcagcagcgtcaaatcctcctcactccacaggatccttcctacatccaaaatatcaaaatcaaaacccgcaggtctcatctaccatgaatagaattgtttctccaacctatatgttcgaaaccgatcaggttcatggtcctttcagtaattctagtagtggcagtaatagtagtggcagtaataacggtagcacagcaaacagtaataacaataatacacatattacctaccaaccgaagtatttcaacacaaaattcgatgagttaaggaatagagtgttattaggatcctcaaacgcttttccgaaagtagagtcggctaacaagtatccatataatagcacaatggtcaacccaactttgaatgatcaagattccaacgtggatgcggaagctgccgcaatcatttctcagatgaggtcttccccattacccccatttaacgaacagttcggctctggcaatcatgatagccgaccgaattcgtcattatcaaaccaatctctccaaaataatgcctttaatccgttctccaaaagacttttacctaagccagtgcttcgggttaaccaacgaccattgactggcaaccaggatgaactcgttataatggaagaagaggatgatgatgatgacgggtatggcgatggtgattacgaaatgaccgaagggggatcaaaggcaccagaaactgttgcatggaataagaatggaaaaagaagattgtccagaagaagatcaggcccaccacattatcaatctcaattgacaggaattaaaaatgagattggagaccatccagatactacggcataccccgctgcggatatctcggaaaatggtatgcatataaaaagatcaaggtcttcatcattatctactgaacacactggattattgtcaccgaattccaaacatgccaaacaactgaagtttaaagaatctaattacaataatgatgtttctaacgagcaaatggtcaaatcaagtgatcaaataaagaaaagaaatgctacgggggcacggtcaagaactggctgctggatctgtagattgcgtaagaagaaatgtacagaagagaaaccgcaatgccagaactgcgtgaggttgcacctcgaatgcttttacgacatagtaaaacccgattttatttcagatcctgctaaaaaggcagcaaaactcgaagaaattaaaaagaaaacaaaagaagctaagagacaagcaatgaaaaagaagacttggttataatcaaagagacaatcatctctaaattcttctcagacacacatctgtatcatcaggtgttctcagtttttttacaataatggacaacccctcaaaactctatagataccatttttgactgaacttttatgattatgttcacctcccaatatataatatactcagatatatttgctgtaataaatgtgtagactgactttaatatacaatgtatgaattgtacgtattttaagcacaaagcttagggaatagtatggaaatgatttcaaaagacaacgtagttcaatatttaaactttatgctgctttcaaaggaggattgagatgatatgaggatcaacaaaataaaataagataaaataaaagaacatacaaaatatagacacatacattacaaccaaaatttggaataattaagataaaatttaaaaaagtgtcgtttcagtaactaaggaatagagaaaaacaaggcgttaaaaataattatatgtgaatcacttcagtacatgaaaggtaaacacatttttcaatccgagaactattattttgcgctatgaataaaagaaaaagttgaattgatcatcagccttttcagccattgaaggcaaacgatcccctgcaatggagacattgttattgggaaagaattgagagtcccttctgatattagttgaattctgaggatggttttcttgattttgcaagttgtcaaattgtggtgagaacgaagtgaatggattatggaattgggcatattgggagcccatatatgttctctgttgagcttgttcgtacagaccagcggagttgttcgcctgggatgacataacaacactgtccctggcaaatatacttatttgagaatcatgcgaagcgttctgtaaatagttgaaagtggacagattctggacattaagtttaggagcttcattaaggccgttactattttctctggaatcagtagaactgccattggtgttagtggaagacagtggtatcgaagaggacgaactttgaacatggatagatgaaaaaggagatgaaacagagccattgctagtatttgtgctagcactgttgttgccgtgatttgacatctcggtcctattgtacaaactgaaagatttttcattctcacttctttcaactgtggttgagacggaaaatgatggcgtgacattaaaactcagtggcggttggggagcagaagaaccactgtaattccatacagggttagcaggagtcgtgttatctttcacagcttcttcagtataatgtggcgatgtagacatgtccatactacttccacctgatgcgttactgttctctctagtagtgaaagccacactgaatccatttttctgtgggtatatctttcccgatccagcaccatcgatggagaagctttttgttacggactctggtttagcaatattgggcagtgagttggctttaacccttttaacagctgtatggacgtatctcttcttttccgtatctaatttgaaaccgcaacaatttttctctaagaattttttgttcgaataaactaggacttggactcttgatgagtgctcttcctttgcggtaagcttattctttgactttccaactaacctatccggtaagttatccatggataagagcttttcatcattaaagtcagataaagtgaatttcgtaggtccaaattcttttaacatgatatcttcttcatagaagtaatctctggtcggtctatgtagatgttcgaaactgatcgacaaatcattactagacagtaactcgtttgtgaggttgaccatagactgacagaaagaagttgatctatgggcgaattttagcacatttttatgagattttatccagcacatcattattctagccattgccaaatactgaaacatctcgcagtttttaaattccttcataatgactttatcaatgaggtgagtgaaaaacttgaagataaactctaaaaatttggtttctgattgtatacttctaatattgctgttgccactgttattgatactgttggcggatccgttcccgttcatcagtgttttatcattaggcataatagttgcagcagatgaagttgtatttgaagaaacaccattgatcatttgatacatgtggaaactacctattagaaggatcaaatcttggaaaatcatagaaatgttcttaatgtacctaatttctatcttatcgaaaagcaaagtttgaaaatgcttcagacgatctgaatgtctattattcttccaagtctgagggaagatatgagatccgattaatggaagaatataaaactccataatttccatgtttattattctttttttaatagtttcctgcactttcaaatcatctaaggagttaagtagtttcttgaatagggatccgttgggatcacctaacaagtttgtgaagttggggatcccagcatcacttggtaatcttgacaaagagcttctaacaaattgataagctgcattgccgaaatttttggtatgcgtgtagcagatacctctttgtaagaaagtttctcctacagatggcacgatagtggaagcgatatccagatatctcagaggtttctggaaatctgcctgttggtatctgtcggacaaatgttccattatgatcttatatctttgggaacatccgatgtagagtaaacatctttgtgatgccatgacgcaatcaatagaaaaagagtcctctggttttaaaacatttgaagcatcatcgttcagtttcttcgttgagatgttcaatttcgatctagtatccgagggaatcaatgcagtaaggttgtaatttgcgaatataagttctagcgttgaatagtaaagtttatggatctgtgggaagattttttgtagaatagagttcaattgcctgtgaccagcatagttcggtctggaaccctctgcaacgttcctatttctccaattttggaaatacttgaatatggggtaatggacgtgcttccaagtcaagtccaaaatacgatgtgcatctgacgagcggatctccgatttttttgatccggtgtcagtagtaatatcttgatgaaggccttccggtataagcgactgaagcaacatctgcatgatttttgaatgtatcatttgaatagcgcccttcatcaagctgtcatctctaaagaaatcggtttccaggacagattgtaactgtttttggaacccggaaaaggtttcctgtaaatcagtattcagtttttgatccattttataacgtatacgctcatccaatgggtacaggacaaaaaagagtgttaagattaggtattagtactattatcgtcgttgtgagtgggagaaacaccgaaaaaaaaaatctgaagctctttcttctttccttcaataacagagaaagcttaattctaaaacctgtaaaaatcaacaaagacaacaggagacgaacaagttatgagtgagacctttctctaatcttcttacttgagtagcagggactgaataaatcaaaagaccaaaaaaataacaactatgatacggaataaaaaagaaaacctaagataaaaaaaaaactctaccttagtttcttactttataacggtttttttgttcctcaatttttgtaaatctttcttgccttgttctttgacgaattttttaaagaaaggtttacttttttttttaaatttttcaatattatttccgtctattcttctagctgggccaaaatttgagttttctttccgtctgatctcctctaagaatctcctttatatcttcacttcctgggttggaaaatgtctatttattaacacacttatccagaatagaatagaaatatttcaatgtatcacacacaccaaattttccgaaatgttgtgctgtgataaacgggcggtcgtttgtgaggtatggtgccgataagaaagagagttcaaaaagtaggcagtaaagaaagaaaaaattcaaaaacaaacacacacgaaagtataaatactaaagagaaagaaatttggtgcgagtgtaataatccacacacatacaatgaagaatcaaccgacagagtataaaaataaaaaagtaaaaaaaaagaagtagaataatctgtccctataataacaccttctctagtttcactggatgaatagatgatataaatgacctgatctgattctgattctgattctgcctggatatatcaaacatatatgcaagcattcaggatctaaaacaatccgaaataacaccgatgcacagacatagtatatatacatatatatatatatgtaattcttttttttcaatactatctgggttaaacaatttgtaggaaatccaaaacgttaatatattgtgcgaaaaaatgtcgacaatactgcaaaaaaattataaaaaaaaattattctcgatctggaaaaaatcccatcagtaatgcagatgtgacaaagaaatcagggagaacagggggaaaaaacgcagttaatttttttttttctcattgattttctttttcatatttttgatatacgggaaggtacatcaggatctgacgcgttaatacaaaggaagagcagagagctcatgagtactcagagatgaacggtcagcagattgctgtcagttatgtaatcgcttctgtgtttaaacgcgagtacgacgatatccctaagtgaggggcagcgggcaagagactttacaaaggcgaatctgatctcgtaggtggacggttctgggcaaggtactcttgtactgagaagaaatcacggggtacgaagtacccccagagatcaacgtgcaatagaagaacactcactgcacgcgcgctgcgcgtgcttgtgaggcctatctggatttgcctccttgtaaattatgtcattgcgcagtacatacgggccaaactccgcaccatgtgactgcaatacaggtattcgttctggaccaaaatcttctcgaagaagaaagagttgggcccagatctttcgcgttacctttccattcccatttccccactcccgtttactgcgtgtatttcttccgaaatctgaaatcattgattacatcactacttctcgtttttgaaaaaaaatacaacgaattcaatacaatttgctcacccggatatcagcaagccattgaaccgtcctagatttgttgctatggcgggtcagggacaaagcggtgacctgttttcgagaatcgcgggaagtaaaagtacaaaaaggaagcaatttaggccatattaacatcacgtgcttatagcgtgacattaatttcttaaatactcattgatcctttctttgttcatattattattattattattattattattattattattattctttacatttggtatacacttttacgcggcgtttatcacttgaccaagggtgggacagtattggtctcatcatctccatggtaaaaatactatgcgttgctgagaagaactctattgcaaagaatgtcgctcagatcctctctggtgggagaagcagtatgagaccatcgacttctccatatatcaagaattacgatttccaatacgatttccaatggcttaacatgggccgttgtaacgtgacaatgacagctgtcgctggtcatttgatgaatttagcattctcacaaaacgaatatggttggggtaaatgcgatccgaatttgttgttcgatgcgccaacaattgacgagatggacgataagatcgttaaaaatttacagaacgagggtagacatgctacacatttgatgatttggaccgattgtgatcgtgagggagaatgtattggttgggaaatcgtacaagctgtcaatagatcaaactctagcttggtctcttcagattcggtgtaccgtgcagttttctctcatttggagccatctcatattatcgcgtcggccaatcgtcccaggaagttggaccaacgtcaggtggacgcggtacgagcaaggcaagaaattgatctacgagcaggcttggctttcactagattacttacaggaaattatagatcggtgttacaatctgatttggaatataaacaattggcaaagaaagatgataaaccagttatatcgtacggaacttgtcaattccccacgttgggtttcgtcgttgatagatatgaaagagttataaattttataccagaacaattttggcatatattactctctgtcaaggatctcgatggctcagagagtaaagtaaaattccagtgggaaagaggtcatcttttcgatagactggcagtactgtccatttatgaacattgcatcggaacatgcgaggatagggcaaaagtaatacatgtttctagcaaagatacaaagaagtttcgacctttgcccctaacgacggtcgaattgcagaaaaattgttcccggttcttcaaactaagtgctaagaaaactttggacgctgcggaaaaattataccaacaaggttacatctcatacccaagaactgaaacggataagttcccagcaaagacggacctcaaatcattgctcaataaacatcagggtcatagcgaatggggtccttatgtcacaaaccttatgaacgaaaattcaactagtacaaataaataccaatggccaagaagcggtaatcatgatgatcaggcgcatccacctattcatccaattctttgtgttgacattgcgaaaactgataatagaatgacctcagacgagaaaactgtttataattatgtggtaaaacatttcttagcttgttgttcaacggatgctaggggtagatcaactacattaaagcttgactggggtggtgaaacattctatgcaaatggtattcaggttcttgaacgaaatttcttagacatctaccaatgggcagattggaaatctaatgatacgttacctgcttaccagatgagcgacgatgtagtggtatcaaaaactgaaatgaaatcagggcaaacatctcctcctaagcacatgactgaaagtgaattgattatgctcatggacgctaatggtattggcacggatgcgaccattgctgaccatattgaaaagatcaaatcacggaattatattaaagttcaaactggatccggatctggcgcaaagaaaactgcttctgtctttctccccacctccttgggtcgttctttggtacatggttttgaaaagatagggcttgaagaatccttttcgaaaccatttttaagaagagatcttgaaaaggatctacagctaatctgtggaggtacaaaggataagaaagacgttgtatcattaatcatcggcatgtatagaaattattatcagatcacgaccagtcaaatgaggaatttgattaaggtttacaacgatattaaagcagaaagccaaggccaagttactcagcgaaacagagtaaattagtgtatggttaatatggaagataacagtttagatgatgctaattctatctaattaattctacattatatataagtatcatagttttgtttgcatgaattgtttttcttttcatgaatgctgcgttagcttgtcgaggatgtactattttatatttatttcaataaggaacggttcatattataattgcctggtctttcatggatgtggccctacaccagcaagcagaactttgggcttcaacctggatccacactttgatatttgctctctcaaatattctttcgacacgcttttttatgatggttgaattttctccatctatgtattggacatggatataaccaacgagcgatggctttgcagaggaattactctttgacttggcttccactggagactctgtatgtgaatgtgaactttcatgagagtgattgttctcctcttcatgagagttcgatgatgtgtgagagtgaccatgagaatggccatgactatttcctgaggtagattctggccaaaatcgcggagccgtatatccagtcactccaggagttgacacaatctgattcaaaacgtttttcaataaagcgtgctttttgtcgtcaacctttaacaacaagcttgaccctgtagactttagtaatgggagcgagcttagaaggattaacgatgcaataaaaaatgaggcaattggatcgaatatctgcgatttaaagatcttggtcaataaagtagatatgataactccgacagagccaagggtatctgccaaaacatgaaggaagatacctctcatgttgtcattagattcatgttcgccgtgagcatggccatggtcaaatgcacatagacctacaacgtttacaagtaaccctaggatagaaactactaacaactcggtagttcctagtattgtgactggattaaatattctttggaatgattcaatgaaaatttcaataacaattccaatcaacaagaccccatttgtgaaacctgcaatagtctctaagtagcccaacgcaaaaggatacttgtcactagcggggtattttgaaagcacgccagccaataaaccgagaaatagagaagtacaatcgagagccatgtgtagcgagtcagataataatcccaatgacctggatctaaaggaatatagaagctgaacaaacatgaatgctgaattaagtaatagaaaagaaaaaatggatttcgtctctttgtttgtggctagactcataagaagtttactagtagttagaaattctttctcattctcaagaagctctttagagtcatgagtatgcgagtgggtggaaacggagtgactatgttcatgttcatgctcgtttagttggtgctgacaatgcttatcaggattttcgtcctccttaggatgataaccttgattttcatattccaatgaacttggaagtatgccacttataagaataaacacagccgttaggaagtcactttttgaagagcttgaaattgcattaaaagacaaatattgtaataccattgccatgaaaccgataatagtggcagaatattggttttgccataccgtcgcaaaaggttggttatctagagtcgtctttatatcctggcaaacaagcaatagcaccagtgtgcagcctagaaagacaaacaacattgagtaattgatctttgtgatctttgtttggttatctgtcgataaagtaacccaaagatacattatgaccaaagaaatgcaagacactgataataatgcagatttaggaacttttatgtggtccaaataatacagtgatttcttgcttctagctgatgaaaatatgattgcaagaatcaatatatatgacagaactgtggtaaaggacaaagaattattataataatcaatacctatgctcaacaaaggcaagacagcatatttccgtaggttatattcagaggctgtgactagctgcaataaaagaactgagaccgttgatgcctctaccggtccaaggaaaagattcaaaattataataagaaaagatatcactagagtcagagcatgattgctgaatgttcgcagcacctgagaacacaaagtgatcaaacaagatgcaaagatgggtaaaactagatattgaattaacaacggcacatggttagcagattggtctagaatatcatcgtgaactgttaaaatcaagttatttgacaacaataacgtaggatagagaagggtcaacggaattcttgaaagtaatgtattagcattagaacttgaatctgtggtctgtaccataattgcactaaacagttcttccagaagaaccttaaaagttaaacctcgttgaatattaggtggataatactcctgctataatcagaaaccagcacctgtatgtcggttttattattggcccaaatgaaaagagcaaaaaatccgggaactaataaggtacggagaaatgtatacccagttccgaaccaatgcttttcttaatcaacccctcgctggatactccaactcattcaagtgccaattgatccttcctgacacattattcaaggctgtgtcgtttgctgtttcagaatcagctttggtttctttcaatcgatgtgtcccgttaggaaaccttaaaggtgatatatcattacccggatactacgttttcattcgtctcagacatattagcaccatagatgatgagcatcaagtgcggattgcctgctttcaatgcactgtccatccattatgtagtatactgttttaacgtatctggaagtcctttgtcaatgtgttgttattcattaagtcatgtacttgagatgtatataggttgttaatatctgcataatttatgtgtctgatatcctcttttgatgaaatgtgtttagtattaccttatagcttcaagatctggtctccagacttatatttgaagggctcaaatccatacttctgtgcaaaatgcctaggaacaaatcttccaccaacataatggttggcctctggcttcaaaaattgcgcgcaaggtttaggcacagtcaatgataccaaggtatcaggttgaatggccttattatcaatggggcccttatcgacatcccatccactgggcacatctacagctacaattggcactttcttctcaaattgtttcaattttgacaaaatatcatcgaatggggctctcatcggtggatggaatgagaatccaaacatggaatcaatgacacataaggtattctcatgctctagatactctagccagttgtcctcaccttgacccaagacaggcacgtcaaagaactctaattgtttcaccaattgtccgtaaaactcttctcttccggaccttttagggtaatacactaccggttcatacccgaacaacttcaagtgtctagcacagactaacccgtcaccaccgttgttacctggtcccgagattaccaatacctggctcttggaagattttaccgggtactgttgtaacactgcttcagctaccgataaccctgcgagctccatcaattgctgtaaagtgaacccaacagggcccattaactcttgatcaatggaagcagctacttttgaactaacaactttgaatgacatttggaattccgttagagtgtgatagtcgtatagccccagatccttatggaactttctaaagccctctcttcttccatgttttacacaactatttcttacagtgcaaggtttccctttattttaacatttttctgcaatgatgagtatggtcataggagcggaagaaacgaaacaattttgtagtcaataagaatatgattgtcggcgttttgtttataccattatataatacagtatgtatatgctattttgtaaggagttcattggttgttccctgctctcactgtcgaacggagatatttcatatcttccatgattaacttcttcaaccaaatgatctcttttcgttgttcctctaaatcgttctttagatctgttatatgacggtctttttcttgcaacagtttttcgtacgtccttatagtaacctcagttagagatgatgtcttttcttggtcactgactggtggtgtattttgtagttgcaagacatctcccacgacgtcggaatcttttctagtgatatatttccgtactcgctttctcgcaggttgctcttcctcattgatctgttccatagctttcccattggtactctcggtcattgctctgggccaatcaaactggctattgggactttggttggcatttgcctggacgttagaatagtaatcctgatcttgtactctactcacttgttccagtttattatccacctgtgataatgaaaagtccggtgaagtgattgtatttacaaccgatttacgtctgggggcaagcacgggcgattccctagcagacgcagtggtacttttccctggcctcctcaacggtgttattaaccccgttgtcttgtcgtagactttgtcgatgttgaaagataatacctgccatagaggatcgtccacgttatcccgtatcttccagttgttctcatccaacttcaaaaaataccgattgtacgggctcacgtcataacttagcaatatctctttcaatatctgttgaaatcgctgaaacaattcgatatttgatttgggtacgttcgattgttcatctaagggtacgattgtcactagagcatcgtaaagttgtgagagactttggaaatattgcatatgacgttcgtccaagggtttcagcgatataggagattgctgattcggactaatcgtggaattcaatagctcgggaagctccaagacttctccgttggatatcaattggtaacccttgatcaaaaatacgtcgagcttgatctgatgatgcatgatgcctgtcggactactatgtgaagtgctcccgatatcagacatggctcttccagtatgtgtacgtagcaggggagggccgatctttgaagtccgtaacaagcagttcaaagaccttaagtatgctgccgcttccgcagattttctcgcttactgtgtatttctttctctctttctctctatctttcgtttcgttaaggtgcaacatttccacattgcatcaccttatgttctagcaagaactaaaagcgacaaaattgcaaaacaaagacgcatctcattgaacacatagagcccttctgcaagggctaaaatccgaagcctttcatatgtagaccaaggcagtaccaaagctagccggacctagatcgaagatcgttatcaacttataacgtaatccactgacggacatatacattcacatcactgagacagaaatataagtcacgtgaagaagtggcgccatatatatgtatatatgccttagttccccaatacatagactagttacgatatgtggttcatcgaactgtaaccatttgatgttcccatgtcactggtaacttttgtccttgccttaggtatctttgagtgtctcatttcccatggctatgttcgagccttttaatcggtgaaaagtttcgaaacggttaatatcacgtaaaagatatcaattccatatttaaatttagacgagaatgtaatttgactgaaacaacaacgtcttttgataaaaaaagtgtattctatacgttgcagagctacattaatcaagtgaaccattgaacgagacgagtttcaatcaattggataggaatcattgtactttggcgattctatttagaatataattggaagtgaaaagtgaagccgtttgatcttggaagcaataaaaagatgtccgctagtcctgtatctcaggtattctcaccaagcaacaatggggtcagtgtgttccgtagaaagaaggagaagagaggtattactttctcgatgatgttggttggtgcttctggtactggtaagaccactttcgctaacaatttattggaatctaccattttccctcatagatatcaacaagatgttccagctagcacgaataacgagaatgttaagattatccaaccaactaaggttgtcacgttcaattcgatgaacggtattcccagctacatgtcggcatttgatccagcctcgccgtttttggaaccaggtatcactgtgacgtctactgccctggagatcacgacgaaatctagtgaggatatcgatagcgctacccctgaaaagatcaatttctttctcaccgacaccctgggactgggtgaaaacttaaataatgggatctgtttcgatgagattgcttcatatttggagcaacaatttgattcggtactcgctgaggagaccagaatcaagagaaatccaaggttccaggatacaagagttcatgtcgcgttatactttattgaacccacgggacatgggttacgtgaattggatgttgaaattatgaagagactatcccgctacacaaatgttctaccaattgtcgctagagcagattcgttcacacctgatgaattgactaggttcaagaagagaattatggaagacattgatagatttaacgttcctatctacaaattcgaagttgacgaaaatgaggatgatctagaaacaattgaagagaacaaggcattagcgagacttcagccgtttgctattatctgcgccgaccaacgcgataatgctaccggtaaatactatcgtgagtatccatggggtaaaattgacatcgataatgaaaacatttcggacttgaaattgttgaaaagggttctcttcgggtcccatttgcaagagtttaaggacacgacacaaaatctgttgtatgaaaactaccgtgctgagaaattggcgtctgtgccagcctgggacattgaaaacaacgaagttatagatacttctatcaatgacgaaaacaatgagggtaattcttcagggttgatgaaagggttgactagaaacagtacagctccatccttgtcaaatttcgcctctctaataaatacaggaaagtttaagtctcaacaatcacttgcaattccacctcaatctgaaaccccatctacaccacgtctaaccggggtagatgaaggagatgagtctcgcgcttcaatctctgccagttcacagaaatctactcctgccaatattcaaacttctccagaaagaacaaagttacggaatatttccgaaaatatcccatacatgcttcagcacgagcgcatagtagcaaggaaacaaaagcttgaagaattggaggcacaatctgccaaagagttacaaaagagaattcaagaacttgaaagaaaggctattgaattgaagatgaaggaaaagctactaagacaaaactcacatagtcaatctcaagaatctatccagactaatacaactaaacaaaattcaacttctggaggtgcttacattaagaaagaggaaacctataacgatttagcttcgataatcagcaaaaaagaatgaattcagtcttgatatctttctttggcatttttgtaagtcgaagtgtttggttcctgaaacgatttcatatgtaatttaaacaatattgattattttgtatattgcaaacggtcacgtctagattgatctgctacctgtttccaaatttgatgagtttaagatggtgatgtaaaaatcagaaaaatatacgtactgttacaggtatatatatatatataatataataatgagttaaggtattttcgtgccacttatcaataaatggaatttatctgttcagatgacatagtattatgagataaaaaagattggtgaaaaatttatgttcatccagtgcttcaagataaaaaatagctagtgtaactggagagaactaagaaaaccgaaaaatgcaaaataatgttcccgatggcaattaaaaacatcaagaaacaacattcattcagcgacgatgagaaaaggcactgggggaaataataggaaaagagatttaaccgaattgaaaaatggttgcaaaataacattaaagagttggaaacaagacataattgatcaataaagacttcaagtgcgaacataagtcattttaacaacgcaaaaaagggttatgacgacgtaaatatgaagtgtaagaaaaaggcaatgggaagatgatctttttataatatttttcatttggagaatgcattttcgtaggagtaattggtagtagatgactttagatcattagtgactccatttgcaagagtggcaatgctactattgttactaccagtgcttccattattattgttgcttgaacttggattgccgctgatagttttaccattttgagcattatttgagttgctagttggttggccagaaccactgcttccactccttctgctgtttggaccacgaacaccaagtgggtttttagagaaactcaatctaattccacctttggtgttgtgtgcgccaactggtcttggtaattgactaccatataattcggctagagctcttgtagcatgtgcgacgtcttcaaactcaacaaagcacataggaccatgcccactgttattgttgttcttgtttctgaatgataacctcttgaatcctttttgacctccaaatagttgtcgtagttcttgttcggtggcatctggaggtaggttacccacataaagtgtattgcaaggtggattttgatcggctggattggctggaggaggaactcttgctaacaacgataagtccacctgagaaattccaggagtattctgtaaaacacttgccacacttctggtgataggttgtgactgagtagagttgttagcgttaacattagttgcagatgaagaattactaatgttggttctgctgccagatttatgaggagtatgcgacgttgatgaagttggtgttacaggtttagaagacacagaagctgaggacctaccgttcatctgttgggcgacaccgacctgtgaagatggatcagagtttggcggtaaatttgtcgcacttgaattggcctgttgagggccagagaaaacggaactgctttgctttctagcagcaccattcttggatgcagaccaatctacaactgcattttgttgttgttgattgtacgtggtatttaccatgttgttcacagtagagagtgaagggtttgatccccaaattgtgtcattaatgccatctccttccattaacaagaatgatttaccagcatcgatgttttgcagtggagtttgagcagacgtttgtgcaggtggaatatgtggattttctgcgctgaagggatcagaaaatgagaatctagaccgttgtcctagcagactgggccttttccgacttgatgattggggaggcgatgtcaacgttggagcaacgtttgaggatacgcttccggatgatggtatttgaaatgagtttgtgttcagttgtggctgcaactgaggtgagtttgtctggaaaaacagctgttgattagttaattcgtcgatgacctccaccgccaccttgaatggatatgctggaccgaatatttgggatttgatattaagaatagaggcatattggcatgccaaatgctgagattcaaattttgccaccacgtacggttggttatcttcatgaggtatcacatcaatggatagtacaccatgagccaatgagaaaagggcataagcctccctcaagtttatgtcggtaggaatattgcgcaatatcaatagataactaccaatggatggggtttgtggttgatttccagtgttaatggataatgtgttcagtaccgatgagaggtttagtggtgaaccactgtggtccgagtggtggcgaggtattgtcgaaccatttgcatgtgttggcgatgcgttgctgggattaactgctgataactgttcagagctagtactgaatccacgatgcagctgataagttgtatcgaaggaaggatggatcatcatggggttttcgttgatgttattggagtttggatttgagttgatattgcttattggcatatgaatgatggcctcgtcgtaagaatgatcaatgtgtggaaatgtgcactaaagtaacactaatgccaaaaaaagacgataaatgagatgaagagcgaagattcactttttgtcaaacgctcaagaaactcaattaaatagcagaacagaataatcaccaaagaaaacaatgttttgctttcgacaaaatgctgaataattgttgaactgtgtggtgtctctctatcgactggagttcttctctaaggttagaatattggtggatgagttcactgtttttttaaccaatcacaaaaggatgggaagcagaaaatagaagaataaactgctattctccaggtacgtgaacgagtgaagtacgcaactcctatctcactgttacaaaatacaattgataatgttctgaaacaggactgtactcctatgattcacaagaagaatgagacttttttccttcttttccctcttctcttttgtttcttgaaagttttatgtaacccttttgttctttaggaagtaattaatttttttttatcaaaaaaaaaattcctttaaaagatatcgatcgagatgggttatttccaagaaaatagtatgtttccaaaaaccaaaaaaaacaaagatgaattttaagaaaaggaaacgaaatgataaaataggtataacaaagaaaacagaaatgaaatcttacgctcaatgagttttttggacttaggcctctagaattgattgatcttggtcaattaatggcctttcgtttcttcctgttacactgtcgccaaaaaatccttgtaaagacagttttctgtcggaacacgctatttcgtaatgctgttatttttcctgtttttctctaattcagcgactttagtgccctgtaagtcgatgctctgaattggtgtctctgtcactctgctcgagtttgctcgtgtcggtgatagtaagtatacggaaatataaacaacaaataactgatgagcttcaacggtgaccggtgtttgcagctatgtttgtgtaagcagcaagtgtgaaagttgatttcactaagttctttcgttcttttttcctttttttttcctttttctcgttttccctttccaactttttagacaatcatttttttttaaattcatttgtctcacgatgctggtaattcattaagtattttgataaccattaagataatgaaagtgggaagagatgcgggtaaagtagaaaatgatcttcgtgagtaacactttagctcagtcgtttctcctctgtgcttgccaaaatcttttttgcgcgatccctttggtcgctgcgctttctacctgtttgaccaaaactatatattttatccaactacgattctcttgggcgggacttatattctctacgaatgccaaagcgactgattaatttagtttagttacttttttaatgagattgtctgtattgtgtcgctgttgaagcacatgcacgtcggtttactcgtggaacgcgtaactagtcagtgtgataattacagacaaaaatgggggaaagcactcaccacgatgattcacacgtgatagtatacttcaatactttaaggttgtcgtttttgactgttattattttcaaacatttcaatacgtggcaaaaatatggaggggaggaaggagaacaagtagctatactacatccgtaaatacattcttagaaagcttggctgaaccgaaagatatattcaagacaagcgtcccgatgattcgattctttgcggaaataagactcttggccgtctcgaattttgtagtcattgtcttataagctctctcaagatgtacgagtacggaatccttttagtcgcattgcacagcctaagaaagttcggttgccatattgtgaaaaagtccgtttcaaacatgaaaccggggggagggttctgcagagtctaattcgtttctcgccacagtggccgttggaacccttgatgatttaggtagggtaatgattcgtattgtgtgattacatcgcgtgatctgcggtattgaattcccgtccataacgaagtggattggcgtaataatgagaagcaggaccgcagtcaaggatggaatgaatttcggctatagagaactccccgtcaataagaagttagttgaaagttcaaatgaagaggaacaaaagagttgtgtaggctctttttatttcatctcagtgtttctgccaattctctaatctcttttagattctctctcgggtagtggtcttttttttctggtttatctaagcagcattgtggtatgtaactccatctgccatttgtgttacatgcttcaatttccctcgaactagttagatcctgacagaatttcaaagcttcggagatttttgcatcaactttcgcacgattatcgcatacttcgaagagaccaatcttgtctttcttgctttccgctgtagactccggtatcgttattggagagtaattaatttgatatccattgtcaacgctactataagatgtaaaacttgacatcctgcttggtctccgtgacattggagagacaagactatctttccttacgcccttattagtcaaactggcatgcattacgctaccgttatgctctgttggtgtctcaaacattgcgtttaactgcatgtcacaaatactgcttcgaggagacttaattgcatctttgaaaacaaacgccgagtctagtgtttcccttgacgaaatatctttgttgaaatgtagctctcgccaaattatgttttcatctgaggcagatgcttcaactttagtttcgattggaagtatggtctttggtttatcttttttgggggagtttgacaactttttatttttagccgctgaagtcgccttttccttaaagttctcctctttcacctctattgaagctttgattcctgctttaatcttacttgtccttttttttgccattgtaaccttcttctcgccgtttagaaatataggtatatgctgttcatgtcaagaatgtgctcctccctgttgtttgtagcttcttgacgttgtattttcatttcttgttcattttatatgaaacaatataaaaaattgtgatattccattgtaaagaaatgaaacatcaaatcaaaggaacgtgtagatagcgtattctccgttattcaatacggcttggaacttttgatatgacgaattagaaaactgtgatatcatattattattgagaaagctatacataaaatatgtcgacaaaaaaatgactgtacaggatgagttaattgctaatgctgaatactgataggttgcagttttatcgcaaattagtaagaactaacttatagagtcagcatcaatcgccgaactgaaaactgatgaacctgatgtgattacgaccaaagagagtgataattgttgtggagaaaagctggagggaaataattcctgcattaaaaattgtaaaaaagtaggtgttttattaaggctcattcataaagatagcaacgcattctacgtcattaccagtgaggagatctcaatgtaaggttgatttgatagtgtttgagatcttgttgacaacgtttccattctcgtcagtggtgtgagtctccttttgttgcacagatcttggaacaccacttttggtatcgtattgatatccttcttcatgttgcgataaaccatgcgactttgcttcggaagtgggacgatctgtgtttccttgttcatcaactgacacatttcttgtatgtctattgttgtctgaggatgtgtatgcattctccgtggagtaagtgttcttatcgggatctaccaagcttttcgaatttccaccgtattcagaggaaaaagtgcctggaatctggttatcatgactgtcaccaacattaccggattttttcttaaggtcttctgctgttagagcagcacccatcgtaggcgggatagaattcttctcagcaagtgctggaatacctttcgatttcacggtccctttaatctcaccattattagatttgttggatgctcctcctctggtatcagaaatatgagtattccccatgtcctgctccaaaccatactcattctgaggatctgaaccagttttttgggattgcgaagaagttttacgcaaaccgacagcacccatcacagaactccaaagacctgagtcagcagtgttttcatcatgtgcagcatttccgtcgtgcttcacgttaggatctaaggtatgagaagttccttcataagccctactagaaacgtaattgttgtcaacgtaagttccctgcatgtcttgggaagtgtgtttttgagcatttttatgagagctatcgccagtgattggtttttcgtttttcttctcgaacacattggtgtcaaattggttaggattaacgtactgtgatgtgttatggaattgattttgttggccggaagacccgccgtaagagccatcgttttgactatcagtagcatcgatagcagagaacttctgctctttagtcgtgttactaccagtattccttgaaattccagtgtcggttgctacagcattggagctttgcttcaacgcatagtcattaccaaccaatggttcacttgtcgcatcatttattcccttggaaggcattgatttttgagggacagatctattgtactgcgtttcagaggtagcagactttagggtatgcttggcagtcgattgttgcgattcacttgaatgagtgttcgcaggtactgaagctgccgcaaccctagttctagcatctttggcctccttatccttgaagttaccgtaatcatacttgtcttgaacattatcacgatgagtttgagattgtgattggtgtttggacacgtgttctttccccaaatcagaatcattgactgtgtgcttagttggagaatttgactcctcttgttgcttcttagatttgtcagagtcggactttccacctagacctaaggtagccattatagcatgtttgttgaaagaactctttcttctgtgcttcccggagtcttcactttgagggcgagtatctctgtcataaatgtctgtcttctcggtatctttagcggcatatttgctagaaccggctaactcttggccattccccgatttcaatggttcgccaatatttttagtagttgcatagctcttgctatcgttggtatgaactggcgtatccgaggaaccaacattaacatattcttgttgttgagcgtttctgccaggatggtgcgaggataagggctcattacctccaagtaccgacccatgatgcccattcgagtcgttcaagtttctggcatgagatggtgctttgaccccaggtggatgatcatcgaatgtgccttcattgccataagatggatagctcagaccgtaatttttcttatcactgtcacttgggaaactttcattgtagttttggccaatgttggttccaggctctgcttggtttctagatgtttgccagtgattatcatgagggtaagcttgggtcccagaggtagttgtggtttgttggtgagaattgttcaagttcccttgattagctgatgaagactggtaatcctttctggaaggatcgttggattcctcttcatgaccttcgagatttttaaccttgttaacaatgttgttgtagacgctaattaaaagaaaattggaaataattattaatatgtgttagtattggtttcagatgggtatcaaacgggagaaaaaatgttgttttctagtgaatggcgtttttttattgagattcgagtcgttatgtttaattaattttgatttgactacttttgactacaattaaacagcaacggtgtctttcttcttgtagcgaagtttccaccatttgatattttgacggttgttgtcattgacaccgctttcatatgtgtgcttgtcgacgttgtaactatcatcatgagagctagtaccctcatacggttgataagtgtttgctcctttgactttctgaacaccaattgtgacactcaaaattattgaccagaacgaacttaataataataagaacactgaggtccataaaaatgcgaacatcttggtgttcatcgatgctgaacgaccggcatcacggaaagtgttacgacctttcacgtaacaagctgtgtacaaacaggctgccaatgtgatgaaaaataaagccagccaaatagaaacagtagacaataccgcaccgacaccaaccttgaaaaaggatagcaacacaggaatcaatgcgagtaccacgaagaataaaccaatcaacaacattgcccaaccaacacgacttaaataatagtaggtattacgattatctctaaatgatgctggaagatcaggactgtttccaaaattgtctctaggggaaaatggtaagtccgcttgtttgcctgaacaacttccgatttcaccattctcataagcacaccaatggtaattgaaccatcttgtagtatctggagcaccaggtaacccactggtgtcagcctcaaaccaatagaatttgtccaatacaccagtagtcctagcaccagacaatataacaaaaaacgtcaacaaaccagaacccaataagaaaagcaacgataacgaagaaacgaaccctttgaacttcatgatattattaaaaattagtattatatggttattattttagctttgattatggagaagaagaacaaactgagagaaacaaaatcacaccaaaacaattaacagaattaaaaaatcctttcatccaaaattagctcaaaaggtaaaaggttacaactcaacttggacggtcaactctttaatcttgatgtctttttataacaaagtcaaccccttaaattaatatcggtagatttaaattgtataccttattctttaacggaagcaaaaacaagacgccgaaaagagcaaacataaatgcctactgccacacaccctttagaaaccctttttgccctactttgagcggtcattcagagcaataaagtttcttctgcaggatgtttctcttcaaatgcttacctcccctaattatttaggtactgagtttcttctctgttttcttttcgactgtcggcattttcctttttccaaagtttgctccggagaataagtgtcaaatggcttatataatccatgtcgagaaaggcagtgatagcaaacactcagtagagatatcctgcacgagacagtgagtggcaactggaggcatttggatgagagacttgtcgagaattagaaaccgcagtcaatattcacagttcaatagtgtgcccattcgttacaggaaacaaaatggacacttgaagccttttttttgattattctgtcagttgttctccgttggataataattgccttgctcaaaacgccatttctatttctcagacctcttgcatttggacgttgaatactctgaattgtatgattatctccgaaggataacaaaacgtatccttgcttagcgatttatgattatataatcactaatgttccttcggctagaaatcatgtatatttatggcattcgaatccaactctgtggtttcccgatcttagaggtgttataacgtattccctcagcttcgagaagacactaaatggccatgcatatgttacgattttcttgttgcacgtttccttagagaatttcgttggccaaagcttgaattacatcacttatgattaatagagagttatttggtcaaacgcactcagaagtgatattaaaaaatgaagtatccttcttatctgattatcagcattatgtgtgagttggttactttctaaattattacgcataattatacgagtattctattttatattaaaaaattatacaaatgctacctccgctagcgacgccagtataatgacggtgacaagctttcttcatgtaatgaaatcaacttcaaaatacgcctagttcttaatcaatatcggagaggttttcgtatttgagtgtgtcgttatcatactccaatctgctgtgaatcagtaagctctccaatgttgcataaataggacaccatattttgatgtataaatactcattgacgcgcagaactctaggtatcaatgtgaagtccacaatagaaccgatgcaggcggtcagttcttccctcttataactataatttggattcccgaagaaaagtgtcaagttctgtctcccccagatttgcaccttaagaagttcttcgaaagggttttcaattgtacattgagtaccgaccatgccactacgagtaaggtatatagtcacattgttaccattgtcgaaaatacttaaaattttagcagtaactttgatgtctttgtgatccatttgcacgttattcttaatatcaataatgtcaacagttttaggatttcgggtaccaaatagctcaatgggacgagtagcagcgtcttcttctattttgtcaacaccttccctcttcaattggttctcaagcttggcaattgaatcgtcttttgggtcttctgaggaaccggcagagtcatagaaagcttgttcctgtagcagttgcggattctcagacattctattcttggatattggcaagaagcgactcatggttaacgtgtacagttgtatgacctctgatggcatccgtttaaatattttatttcttagaggcttcaataacttgtattcctcagtggtaactggcgtggtaggagtaatgggatcggcgtcaagtataacagtgtttagcttaccttgaaataattgacatttaacagtgaatttgaatatgatacttcgatgggtaatattactgttgcctttatctgcacattccattaaacccatcttgattattgattggagtttttcgtttaatgattccacccgatttagatatatcaatgcatgaacgtgctcattctctggtattctttcctggaaactacccaaaaaggaatcgtacccatagttgactttggggttagccgtaaaatctgtaaaagacagaactagcgttttacctcctgtatatttcacggtgaccgcaagtccaataactgtgtagtacctcgaactcgctgaaggaacaatgttggagacacgtactagtggaaacttgttctctgtgaaggtgacttcctttggagtaggaagagcagatctgaggaccacgtccttgagagcccatttacttgattttgctgctccaatagtaaattccttcttgtaaatggttatgtcgtatcgattattgtctatcagttccttcaattcaagcagcgagttctttattgagtgtgggtaggaacgaaccccgatcttactgaaaaatttagcaacgttggtgatggctatctcgtaacaattgtactccggtacaaaaactgctgaaaggagaggtagttcatatgtataaacataaattagaagaaaatcatcttctataagcgaagattcaggatcaagatattgattcggtataaatccgagaattttaccatcagagatatgatagagcctatcagttattgctttggagatcgagtcaggttttaaatcaaacggatcagacccttcttcttgtattgttcgtggttgctcaaactgagactgagatgagataataggatcatatggtaattgatatgaagaaatatccaggtcctgcctggttacttgccgatgatgggtcaaggcgcccagatctgtaagtttaattttttttacagtcccacttgaaataaaatcagaagttgacatacctttgttgctccctattggcctcttttgttcttttgcgctttgtattatggaatcattgcaaggattctgttctaaagaactgaattgaggcgtatcactttcgatggcagttttagtggattctttcgcgacttgatctgcttctccatcaggattggaactaattgattgaagaggtaatgtatctatattatgctgttgggtttgggaatcaaattcattgaaactgtcgttattcacctctctttgtaaacccaactggaacaacggattcacgatagctgtattttctttcggaagtaacctggtggggggtgcttcttgtagaaccaaagaatcgaggtacgactgcatttcagtacagtaactagtcaggctcttgaattgaaaatcagcgtttcgtttttctcttttcaataggtttctaaacagcttttcgatcgaaggcttgagtagcttatattcatctgcagtggattggtcaaagtaggattttaaatccaaaagtttcagttcatgaatctgtagagatgctttatcataagcagtgataaacaaccctttcacgcttatcattcccatgtagcgcttctctaattcttctaacacgaaatcagatgaatagtccaaaccggctatttgcatgcccaacttctcgaataacgaagaaagaaccattcggagtaatacatcgcattcaaagcttttattttttatcttcccacagtaagtgttcaatccagctttaccattggtgaagttatcgaaatggaacaggcatttatcgtttttagtatatgctactttactgagaattgatataaagtgcacgggcttcgatacaattgatccatgctgatagtatttgttcaagcattcaggaccaggaatatactcatatgggtacttttccatggtgctcgcactccattaccttttcctttctttaactgaagttgtttctaacgtttttcttcaaccttcaatgcaccgtttaattcattggatgcgctcataaaaatcatatctcaacatggaattaatatagagatggttcccagataaaacagcgccaacggctgcgagcaaccacaagagagccaaagcaccgaattgaaatggcaataggtgaaaggaaaagtatgataattgaatgtttatcgaaaatttaacaatacattatttactaacatttagccaaatgatataatcaactgtagggaattttagatcaagaaagaaagggttcgcagagcctaaagttctagtgacgcaggacgagtggtacaacgaagcagtaaagatcgaagatggcgcagaacgttggtttctttccgatataaagaagactatgaagggatatctggaggcaatgcgagcttatgatagagccttgatttctgagaaacctaataacgatgacacatacaatatccattataaccaaactagactgttgcttaaaatctatactgattatgtgaacgtcgatggttatatcaacctgcttcaatatgttaatttagatggaattgattccgtagaaaccttactggtgaccattgacgctattatcaaaaggtttgaaactgttgtagagagtttcccagaggaagttggatgggatttgctattcaacctattaatatcgtattctacctatgtggaatctcagactaatatcccaggcgagactctaatcaacattgtaacagggttcatttcgcatttccatcacatcatgagattagagaatgagctattggagagtgtagatatggcaaatttgaacgaacaggaagaggaggacgatgttagttcttatcgaccagataatttagctgaacaatctcaagtagatcttcgcaccggtactggcatcaagaccagaggtgctgagaacgaggattacgggttggccctatctactgaaacttttgacaaggaaactgtcgttgacactgttactctaggctacaaatttgtatatgagataatggcaaatcagcttgaatccgagaatactgctcccggtaagataatcaatgttgcacagaagaactacttggaagaattgttggtaaagttcatcaaccaattggatgatatggtagtaactctaaaaataggccaatctgacgtccaggaattagtgatagcgaaaaggtcaattgaaagtctgaaacttttgtatcaaggagatcttcacatgtttctagataccttgggaacgactgatgaagattcgatgatgagcaatgttgagcttttagatatggcaataaatactttctccactgagaacagttggcaaattcgaacgtatctatcaaggacattgggtaaattacaaacgatacttgccgaaagacaatccaacattattagtggtaaaaccaagaacaaagacaacgagttaagcccaatcgttttcagtttatgcgatgtcatgatcaacagagcggataatgagctttccaggtgtctactaaagcaaacggaattgaaccagctgcagggacaatcgcacccggaagaggatattgttaagaccatcgaattattacaacagaatgcaaagaccctgttagtgaatgcgaaatccatcgcccataggtcttgcggcttcagtgaatacatcactgacaagttgaaaagaaactacatctatggacaagcttccataaggttagacatcatagagtctccacggactagaaaaataccagaggacttagatgatcaaccttcatatcgagctctctgtattccttagggcagaacttaattcccaacactgtcgtggtatatagacggcaagtagcgaatacacttgtagccaacacttgatatatagcatcaattatatcatatacgcctataaaccttggagaaagggtccacagtttcgtatatatccgccacactatcacccgacaaacattcttgcatctgggacccctgggccctctgccgttgagttgcgtactgtcttgtatctttttgtactcttcacatgaccgtttcaaggcttttcgatgtatttattttaagaaactactgtttcaggaaatgatatcgaaatctgaacgttttcctgttttcatagtacataaaaccagggaaactttttgtattgacatattggaatttgatctgagacgtggatgatacaaacaggaggcttaggtgaataaggtttgaggataggttggggtaaacgttcagtaggattatcaagggttgtgaaaccggcaggttcaatatataaaaatgagctacaattataacggccaaggttattaccgattcgacggtgatgaacatagggcatctcaccaagctcaagaaaatagttatcagatgtatgagccatctgaagacgacagaaacgatgaaaatcataggtacagaactgctgccggaacagatgagcagtataatgggtttgtgaaccattatccggaaatgggtgaatatcgccagcctggtgatatgtcccaataccaggtgccaaatattcaagtggatgcgtcaagtcctatagcgaatacatttgatccggcgtatcctgggcaaactccatatgtgcaagcagattttaatgataatcagtattacggtagaaattcgtatcagaatgagcaagcacctagtattaactccgcgaccgattattatgcgaatcaagatacaaggccaatcttggaacaacctcatcagttatacaattaccagcaacaggatgatatcgaaaatcctatatacgtggatcaaaacggtgatgattatcagatcaacacttatttaaacagtaaaggtgatatggtggatccattcgaagctggccagcgtggtgaaccgtcggagtgggatatcaacgattatgttagtaattacgacgacgaagacggaagcagttctttcggaagttatgggaatgacgtggcgacacttgataggcttggtgaattgaaatatgaatcagatgaggacggtgctgacttgggagagagaaagtctcccgccattcaaagaaagccaacggtagttagaaagttcaaattatgtcagggaaatttcatcttcgattgtccaatcagtagccaattgttgtctcaatattctgcaggagctggtccagaaaaattgtctaatgaatttaagttcatgagatatcaagctgttacctgtgaaccaaaccagtttcaaagtaatacgttcaatttacgtcagttgatgtatccgtacccaagaagaacagagcttatgatcgtaattacaatgtacaatgaagatgatattttactcggcaaaactttgaaaggtgttatggataacataagacattttacaaaacgttcaaactcctctgtttggggcccagatgcatggaagaagatttgtgtttgtgtggttagtgatggtagatcaaaaattaatgaacgttctctcgcgttaatgagtgcattaggttgctatcaagatggttttgcgaaagaggctatcaatgacaagaaagtcgtcactcatgtctatgaacatacaactaaagtcaatatcacctctgtgtcatctacgaatgtcgagttaggatatggcgatagcaccatacctgtgcaaatgcttttctgtttgaaagagaagaatcagaagaagattaattctcaccgttgggcatttgaggcctttgcagaaacactaaacccgaatgtcataattctcttggatgctggtacaatgcccggaaaggattctatttatcagctatggagagagtttaaggatccccaagtgggtggcgcatgcggtgaaatcaaagctgatttaggatctggatatactaaactattaaatcccttgattgcatcgcaaaactttgaatataaaatgtctaacattttggataaaacgacagaatctaactttgggtttatatctgtcctaccaggtgctttttctgcctatagattcgaggcattaaaaggtgaaccgatgcgaaagtatttcttaggtgacgaccttaatggtaccgttttcatctcgaatatgtacttggccgaagatcgtattttatgtttcgaaatcgtcaccaaacgtgatagcaactgggtcttaagatattgccgtgggtcatacggtgcaactgatgtgccagaaaagattccagaattcatcctccagagaagacgttggttaaacgggtcattttttgctgcgttatattcatttattcatttctacaaaattttcacatctgggcacactatactgaggaaaataatcttaatgtttgagtttacttacttgttcgtgacgaccttagtttcatggttttcgctaagttcatttttccttgtattcagaatattaacgctatcgatagccatttcattcccagattataaggttttcagagtattttcagtgttattcctatggttatacgggctatcagtgttggtgacattcatcctatcgcttggtaacaaaccgaaaggaacacctttattctatttgagtacatttattttctttgctgttttgatggtgtatatgctggcatgttccatttacatgagtgtttattctattcaaaatctgatcgattcaggaacgactactttcaaaggattaattacgaaagaaacattcagggatttggtgatttccatagggtcaacttatgcgctttacctgttaagttcgattatctacttacatcccatgcatatgtttacgtctctggtccaatacgtgttgttaagtccatcgtatatcaacgttttgaacatttatgccttctgcaatgtgcatgatatttcatggggtaccaagggctctgctgctaaaccgttgggatccatccaatctaaggatgatggtaccgtcaagatggaaattccaatatctgagaaagaaattgatgagaatttccacaaattcaatagtatcttgactgaacctaaaccgaaagaagttgaagcagaactatccttagaagaatccaaatcaagttattatgccatggtcagatctttggtagttatcctatgggtagtttccaatttcatcatagtggccgttgtgttggagaccggtggtataagtcaatacaaagatattgatgattcagcgaaagggtttacttccactgatcaagaggtgtcgattttaaattccaaatctacgatttatttctcagtaatcctttggatagttgcattcatggcattatttagattcattggatgttgtgtctattgtatcggaagaactgtcagaaagctaaggttctaactaagtgttaacaaagaatgtaatataataccagcataccaaaacgttggcgacaattattttctccttttcaaggaagagagaggttttgatgattgattttaatgatataatgataataaaagtgtcttaaaattgaattatcatatatatataatatatacacaataatttgaaaagtataaaaaagatggaactgatggtgaggtgatcattgtaggcgacgtaataaaccactcaaaccagtaaatgaagtgaaatggttatgtgtataaaaaaggaatgaataattttggcagtcgttagacacttcatattattcgtcattttttttaataatttgttgtagtagtttttatttggcgtaaaaacttcccttcataatttgaatcaaagtccataaagcaaagactggcatagaatggttaagataaaggtgataaaaacttagaagtaaaaaatggaatcacttgaaatatcgttagtctcatcaaaagcgttcgttaacttaaaagagtaatttaagcaacgtgctcaaccaaatcgacaactctttcagagtaaccgtattcgttatcgtaccaagcaacaaccttgacgaactttggagacaattgaataccagcagaggcgtcaaagatggtggagtgagtgtcaccaaggaaatcgctggaaacaacagagtcttcagtgtaaccaacaacattctttagcttaccttgagaagccttcttaacagcggccttgatttcatcgtaagtggcttccttagccaacttgacggtcaaatcaacgacagaaacatcgacggttgggactctgaaagccataccggtcaatttaccttgcaattctggcaagactttaccgacagccttagcagcaccagtagaggatgggataatgttaccggaagcagttctaccacctctccagtccttgtgggatggaccatcaacagtcttttgagtagcagtgatggaatgaacggtagtcatcaaagcttcgtcaataccgaattcatcgttgataatcttagcaattggagccaaacagttggtagtacaagaagcgttagaaacaatggtttcaccgttgtacttgtcttcgttaacaccaacgacaaacattggagcagtcttggaaggagcagtgatgacgaccttcttggcaccagcgtctagatgcttttgagcggagtccaattccttgaagacaccggtagagtcgataacgatatcgacacctagcttaccccatggcaagttagctggatccttttcttggaaaacagcaatcttgtgaccgtcaatgaccaagtcgttaccgctggtagtaacttcacccttgtatctaccatgggtggaatcgtacttgaacatgtaagcggcataatcaacagaaatgaatggatcgttaacggcaacaacttctagagcctttctttgcaaagcaattctcaaaaccaatctaccgattctaccaaacccgttaatagcaaccttaaccattgtgtaatattctttttttttacttgaaactgtgaagcgtgtgtgagacgtatgataacttgaaatacctttgaagagtagttcttgtccttggtgttttgacttaaaaaaaaggttaataagaaatataattactattaagtaatagtgacaagagacaagttgcaattccaattctgattcaaaatgaaaaagatccaccctttatatatcaaaattaagtacaattaccaataaccacactagtacatattataatgtaataatataaattagatatccctttatttcgcagcacattgtgctcattagctcattggcccatagagaagatgaagcaaagcagtcgaagcagtaccagtgtgccatagagaacgtgatgaaatggtaagttatggtacgtgatggaacacgggaataggggcgggacatttgggatctggtgaaagtgttgaattatccttcaatagaggaagtccgtgattttctcttcctgtccagtggtttccagtgggatcggtggctccactggaagctggggaaaccattgggtttttgtcctctttttagggacagagagttctagggcatggacaatacgttaccgagatgagggacatccactgttctgttctaacaaaagaagatgaaatgattatcttccggactccagcttttccatttgccttcgcgcttgcctgtacggtcgttaccatacttacctttcttgcttcttctcaaaatggaatccaggtttttagcttcgtgtttcttttttttttttaccatttttcaaatttcagtcttccattttcagcttcttgtttttttttttttttttttttttcatttcagtttttacagcttccagtctccctctttccttcgatttccatcttcttgtttctgtagccatcttcctatcacgtgcaagggaagaaagtgggggcccagcaccttcttttttgttctttggtgggggctcgttttagtttttacgtgcgtaattgggaatcttccgaggtagtatgacatgtccggtggtgacctgatactttctgtttctccgagtaggacagaagaggaaaaaaaaatagcgtgtgatgttcttctattctagtagtgtattgatctattcacaatcagatcacaatcatatgagcagatgatgtattttgggttgcttttcaccaacccaagtattcgattgatctttatatactgcggttatttctaggtcttaaacggttaacacctgttgcagggtggtatgtatttttctcaaagtgtgctattttcacaccagctagaaatcagctgtcttacttgtatacaattagaccagccatttggtcttctggaatatgtatataaacacccggtcgattctgacaatccatccacttttgtagtaggtctctctatatccatttgtacaatgttgtttctgttttgccctacatcatcatcaagcaaaaacaatagtttcaattgaaacataaacaagctttaaacacacaaactctatactaaaaaaagataaaatggccgcatctatcccagaaactcaaaagggtgttatcttctacgaaaacggtggtgaattgcaatacaaggacatcccagttccaaagccaaaggctaacgaacttttgatcaacgtcaagtactccggtgtctgtcacaccgatttgcacgcatggaagggtgactggcctttgccaaccaaattgccattagttggtggtcacgaaggtgctggtgtcgttgttgctatgggtgaaaacgtcaagggctggaagattggtgacttcgctggtatcaaatggttgaacggttcttgtatgtcctgtgaatactgtgaattgtccaacgaatccaactgtccagaagctgacttgtccggttacactcacgacggttctttccaacaatacgctactgctgatgccgttcaagctgccaagatcccagtcggtactgacttggctgaagttgctccagtgctatgtgctggtgtcaccgtttacaaggccctaaaatccgccaacttgaaggccggtgactgggtcgccatctctggtgctgctggtggtctaggttctctagctgtccaatacgccaaggccatgggttacagagtgttgggtatcgatgctggtgaagaaaaggctaagttgttcaaggacttgggtggtgaatacttcattgatttcaccaagtccaagaacatcccagaagaagtcatcgaagctaccaagggtggtgctcacggtgtcatcaacgtctctgtctccgaattcgctatcgaacaatctaccaactacgtcagatctaacggtaccgtcgtattggtcggtctaccaagagacgccaagtgtaagtccgatgtctttaaccaagttgtgaagtccatctccattgtcggttcttacgtcggtaacagagctgacaccagagaagccattgacttcttctccagaggtctagtcaaggctccaatccacgtcgttggtttgtccgaactaccatccatctacgaaaagatggaaaagggtgctatcgtcggtagatacgtcgtcgacacttcaaaataatgaaatctcttccgcattcaagtcatgacttttttcaccttttatatgtttccctcctctctccgtttatataaaacatatctgatcattacttcccacttattccgcctggtgtagtgctactagatcaatccaactttataataaatcattttatagaccttcaaaatgagacacgatataatactttaattctttagctcttttataataattcttaccacccaaaaaaaagggaactaataacaccattataccattacagtacacattgcgaccatcacccttaaggtgaatacatctgacccctaaaacaactggtacgttccaactagctgacctcttaagtacatcgacaatgttcgcttcgaccatcacactgtacgagttgaagttccatgtctaactctgtatacattgtcactgggagcgagccagacacggatctgcatttctagattgaaaaactgagaaagtgaaaaatttggaaagctcaaccagaggtagagatagagatagagacagacataaattaagctgagcagtctttatcttagtcgcctgaggtctttcgtgagcagtttccacagggatagaaggggagactaaaaccaaagatcagaaaaatgttctcacgtttaactggtgtctctttgagacagggtcttacggtacagaaaagactattctcttatgccaggccattgtttaacagctcggggtctgagaggaccggttctggttcaaggcagtacaatgatggcgcccgtgctggtgcagaatatggttacacagggactagaattgtgcctaagttgtctactttttactccgccaacccacatcacgaagctcatatcgataacttagaagcgttgttgaggaaatatatcaaatatcctaccgtccaagtggaagaaaggccttcctggttgagtttgcaagagtacgctctaataggtggtgggtcccgtttgaaatctacccagtataagcagcttttgttcatgttgaaccgtttgaattctattgatccacagttggttaccgatgagatttcgaacactttagcgaaataccataagaagacgaagttgcaacctcaaagagatactttgaagcaattagacgagtttggtagaagtttggccatcggaagaagaaagacctctactgccaaggtatatgtggttcgtggtgaaggtaagatcttagttaacgaccgtcaattaaacgattacttcgttaaaatgaaggacagagaatccgtaatgtatccattaaaagccattgacagtgttggcaaatataacgtctttgcaatggtttccggaggtggtattacggggcaagccgatgccttgatgcatgcaatcggtaaggcattggttgctttcaacccactattgaaaactagattgcatagatccggtgtcttgacaagagattacagacacgtcgaaagaaagaagcctggtaagagaaaggcaagaaagatgcctacctgggttaagcgttgatctgatattagtctctgacctttccattaaaaaaaacacatgcttgtttcacaagtcctgtacatatatagcaattttacataatttaacaagctcctttcaccttttactctgtcgtcctacgttagcatctcgtagttccattagtcgtagtttcaaaaaatcttgtagatccttgttcttccttgttcgtagtaacatatcttcagacgtaacaacatttctgttagcatgttgggcaaaagcttccaaatcaccaccaacctcacatatctgctggtaaaccagttcagtaagagtgttgacatattttgaattgtattttacatcttctggtagttctcttttgataatcgattccacatagaaccacagcttcccgcgtaactgggatcgtaatctcttctcttcatccatatttgatcaactgaacgacgctaccatgaatagagcccacaggacaatgccaagtcaggaattgccagctcaaaactctaaacgaactgctcaatcgattgtaatcttgtatatcttgcatatcttggatatctccgcattcccaatgcatatcaattatattcatgttttcaacagtttccagaatagaggcaatttgcatatatataacgaagacaacagaatgtttgatatcagataaataaaagatggagattacaaagaacagcgttagaaagtgaggcgcaaacgtttttcgtgaaaattactacttgacgagacactagtgaggtgtatgcttgtgaaaatacgagtcaggttatccttttgctcgaaactgataacttatagagacatcttgttttaggtattgcaaaagaataggttcaacaaatgagcaagtatacgttgtcgttcggtttgcttccgttagaactggattctgatacgaagcatcttttgcccatcagctcaattacaaacttagattctactgtgataactactggacgtgatgggaacgtagttattgaagagactcagacgaagttggctgtgcatagcgattggatcagtggcatagcttgcctatctgccgccaaatttttaacggtgtctcatgatttcactatctgctacaactggaaaacgactatttggaaccataagattgtcggctaccatgctgactatgtgaaggggatagctttaataggattagaagacatgaaatgcagatacgccacggtaggtttggataagaagctaaagatctgggaactggatctttttgaggtggagaacgaggaagacgttgaagctaaattacttggaaaattcgataacaccacgcatcatgatgcagggtctatttattgcctgactgctacgaaggacgtcattatctttggagataacgaaggccgtttaagctggtacgatataaatagttacagtgtgataagaaccatagatgacgcagctggtgtgaacttaaagactttgaagcttttagatgatgaaacaaccgttcttagtacaagcgcagatggagagatcaaactttggaatgttgaaagtggcaaatgcctttggaccaaacagttgtcgcacgcaatatggtcggtagaaggaacgctttctaaagatttatttcttggcgactgcatgggtaatataacgcaacttcaaggtaatcagatatctgttatctacaagccaagcgattgcgacacaaaaacaggtggcattctggcaatggccattatagaagatgtgttgtggttctccagatcaggaaattcggatctaaacaagttgaacttgttgagtaagaagctcacggttatagaaggtggccatgcactagtgcggtgttctttgttgacaaaccgcagacatgtcatcacggaaaatacatccggtgagttggagaagtgggatattgtttcttgtgagctggttgaaaaaatcagccgagacgaaggtaatttcgatgaggtggtcagaaaactgaatcccaaagaagtcttacagcactggtgctccgtttcgataaaacgaggcattctttttgtaaagatcaatgaacgtttcctgaataccgaagtatacggaagtgccctcaccgattatgtaatagtcaacgaggataaagttgacgaaattaatttggacgaaagatacaatttgggtcgtatagctgtcaattcattattacatggttttattgattatgaattggcgaaggataagaaattcagagaagatatttcttccacaaagaagcaaactcctccatctactccaaatctattaagaagacacaactcaatggcctctgaccatacgaaccctgatcaacataaagacaacaaaagtatcaaggagaaaagacgattatctatatttaccaagttcactcaatcaaataacactaccccgcaaagttcggcccccaacacccccaatggtatacctgacgtcccacatacatatcacggcataatcgaagaaagcgaagatgagatgggaatgatgttacctggcccagcaactgctctacctacttcatcgaaaccggcgaacctcactttgacaaggtctgttactgaacaaagtatcgagagatctgctacaccttcaagcacatttggtttccataacagatcatcgagggtaaaactagaaactaacagcatcgatgaccttcatagtatctcttctactgggaatggtgaagtgaacttcaaattcaattcaaagagtttttccaaagatctgtctgaacgaaagccaggacttttcttgaacgaatatatcgaagaagtttatcacgcttatttgaaacaggctccaaactcctcatcaacgttcatgaagtttgggaggcggatccccgagactttgttcatcagagactcaactagacccgtgatacaaatcaagagtggatgcattctcacggtcaaccattggaaagaggggtccacaggggaaactattgcattttccacatatctcccaccccctacatatacggcaaacgacttgatcgataactaccatacttatgaatcattagaaagacatctcccgatatggcttggaaagattcttttcaaagaggataaagtcattaagacgtacccaaaaatcacattcatcatccagccttggaaggacgaggctcatttatcggaggaaacgcaacaatcgccagaggctgaaagactagtagtagaacataaaagatcagggttccacaaaaaatctaaaccacctgaatcacccttaatgctaccgaagattaacgatagcaatgttagattaacagctgcaaatatgataaaggcaaaaaagatcaagacttacatagtggatagattcgaatcaaagacacctgagatgaaaaacaaagaagatccaagcgaatggttagaaatcttgtgcaaaggaacagtactagaaaacgatatcaccctgagtgctatacgcactttatactggaaatcaaacacagacattgttcttgaatatagacgtaaaccgacttaaaattaagagagactgtgagactaagttctcacccaggcttatcaatatatatatatataactaaatatagacatatatacaaacatagaactacacctgccgcccttgactcagagcattccataccaacacaagacaggcacgtgactgaaatcatgaaggacgagtttgatggtttggctctgtttccttctttcatcgcattgaaatttcgaaggtttgttgaagtttttctttttcttttcagccaaaattttccaaaatttagaaagcgatgagaaacaaatccattaatttgttgattgaaatttaagaaaagattgaagttaggtagccgaatagtccttgtaccggttgaaattaaggggtaagattagtttgcatatcgataattgagttcttagtacttgtttgtgcatatcgataattgagttcttagtacttgtttgtgcattttagaatttaatacgaactaatcttcaagcggaaaaagttagtttcataagatatcaaaggcaagtgacgcacaatttttgtaacaatggatcaagagcaggagagaaacatttccaggctatggagagcttttaaaacggtgaaggaaatggttagggaccgtggatatttcattacccaggaggaaatagatttgagtttagaagattttaaggctaaatactgtgattctatgggcaagccacaacgtaagatgatgtctttccagtccaatccaaccgaagaatcaatagaaaaatttcctgagatgggttcattatgggtggaattctgtgatgaagcatctgttggtgtgaagacgatgaagaattttgtggttcatattacggaaaagaacttccaaactggtatattcatctatcaaagtggtattactccaagtgcaaacaagattttaccaactgcagcaccagcagtcatcgagactttcccagaagcatctttggttgtcaatattacacatcacgaactagtcccaaagcatatcaggttaagtgaggctgaaaagaaggaattattaaaaagatatagattaaaggaatctcaattgcctagaatccaaagaatggacccagtagcattataccttggtttgaaaagaggcgaggttataaaaattattagaaagtctgaaacttctggacgttacgcaagttacagaatctgtttataagagcaattaaaaagagccattccccaaccctaagtaaagtaaatgcgtgtgtataataatagaccaaattagagcaagagaaactaatagggccttaaacacactcttcgtatgagaacccatcaggggatatcataatctaattacgattcttttttcaattatttaaggaaatgattaatcacgttttgaacatagcatgtctgaattaagagagttcattgatataagaattcgaatttttaggaaaacaggtaaagatcaggaatggctcacaagacgtgaacataacacgctatcccttgttcccttccaccaggagatatctttcaaattaatttcaataagaggagacacttcaacaccctcactacccaagaaggtggcaccaacggtgatgaccagggcatcgataaggtgtggtctctgtagcaaatcattgataacaatcccaccaccttcaaccatgatggattttaatccgaattgagatttcaattggatgaacaaatcgtgccagtccactttacctgtaaaattagtttgcatcactaaatagtcaacgttctcttctacaacttctggaagctttttcacgactacaattggtgctttaccatcaccagaatcaaacaaagttttcatcttggaaccctcaaacttccatttcccgtttggatctaaaattatgggccttggagaatgttcagcaaaatgttctggttttggctcatcatctggccaccatttacagttcaaaccgggatcatcaaccaagacagtaccacaacccaacatgataccgtcaaacttgtaacggaggtaatgggtcattgtattagtttcttgatgagagataatagttctagtccctttgatcttcgcaatacgagcatccaacgattgcgcataagttaaaataacgtacggcttttcctgttcgcccaaaacgccagcattttccggcatgtatggttctaagaaggaaaccaactcctttttcaatggttgtataggcatggcttttgtcgatgtatatagctgacgcgttcagttgtgattgggcagtgatgttcccagttcttaagcagaaaataaaagaatgaagtttttatcttctaaaacttgaagccaatttcgggttgttttaatactcttacactgaaatatatctatgaattatgaaactctgtgttgagataacacttttccggataattcaaagtgatctcagtccgataaattaaaacgaactctcaaaagctctgagtcaatattatttcaacagcacaaatactagcactcagccaacgttgccttgccaaaatagatcacaggtactcgaaaacaacacgttcccgctgaagggatctttccgcaactaaaaaaaagaaacaacattgtggaagtcacctgtgttaaacataccaaactaaaatcttttgaggtacagtcagttgcatgattgttcctgttctgttgtggaattccttccattggttatgttcgatgataataaaagaaaaaaaacatgacgcatcacgtgagatacttttacagctatgtaggaacgaaggttggtatgtgagtcagtagtagctccaaaatgtttctactcttctatgtatccatattcagtgtcttcagtatcgttattggtatgggaggatgctagttggagttggcctttctgcaaacgggcaggtatagagatatctttctttgaattaacaggatgtctattgcgtgatgatgccttcaaatcgaaggaattgaggttggaatcatcgttcaagtccaattccttgagccaaggatcatctactttactgagctgcgatgccctttgcatctcttgttcttcgattaataactgcttatctaacttcttttgcctttctcttttcaaccttgcctgttgtctctgttcccattgcagttgttcttgttcaggattagtattatcagtgtcatcaatggcaattatttgactcaatatcgattgatctgaagtctcagaggctactatattttccgtatactgcttctgtcgaagagctttagctaaatatgcagctcgaactagacttccgttctcacctgtctcttctggctgattttgctcatctttcctctttctcttgagaaatacaggcttgtgtaacgttacctcatcatcactactgctactactgctgctactgctactgctactactatctggaccatctttaccgctgtcactgtcgctgttcgcttttgtacttaagtgaagttcagattcgttcatcggattcgaactgtaattatcatctcttgctgtagtagatttttcgtctgaagacgaattttcagaatcgctagactcttgcacttgcttcttgaagtgtcgtattgccatttcaactgcttgtttgtagtcaatactgaactttcactcgcttatttccctctttctcaagcttttgacgtatactttcgattcagattgtcatattattattatatcattatcattattctaaacagggctaaaaatgaaacatgattccaacgtgaatatatgatagaatctctctctctgaatgcgacaaaattggattatgccaacataaaagctctgccagaaattaagtatgttatatagggggtagtagttacaatttaaaccaatccaccttgctgatccctgtaattttgaactataaaaagtaaggcggtatgaacatggataaatctgttcactcgtctaaaataaggaaatgtattcggaattgaactaggatctagtactaatagttgtttagtatcttagagataatagatttagcagattcccaagattcatcgaagttgaatttttcattttcatgttcggaggagtcttcattagcgaaaggatgctgttcaccgctatgtctctgactacctttctggctgttttctgacttagcgtgtttctcctcatccttagaatgtttcttttcatctttagaatgtttcttctcgtccttagaatgcttcttctcgtccttagaatgcttcttctcgtccttagaatgcttcttctcgtccttagaatgtttcttctcatccttaggttgcttcttctcgtccttagaatgtttcttctcgtccttagaatgtttcttctcgtccttagaatgtttcttctcatccttaggttgcttcttctcatccttaggttgcttcttctcgtccttagaatgtttcttctcatccttaggttgcttcttctcatccttaggttgcttcttctcatccttagaatgcttcttctcgtccttagaatgtttcttctcatccttaggttgcttcttctcatccttaggttgcttcttctcgtcatcacccttgtcatcgtgttccctatcttccttatgtcccttgtggtgcttcttaccccatttcaacttcaatggttcagattcgtgatacaattcaccatcgatatctccaatgtaagcttggaaaccgtatccaccaacgtagtatagatcttccacttcaaattcgtagaatgcaccatcatggaccaaactttcttcaccaggtaaccatgggatggcatctgggtgtcttttaccgtaacagtctctcaaagccttggtcgtttcaagtttcttcaacgaaccgaaaagattggcacgaggagaactcatagcgtgatgtctgggccttctgtcctccacggtaatagaaagcttgccgttatcctgatagtttctcaaagtggaggaaacgttcatcaagaccaagattgggttacctgtggaattcacaccctcacataaatcagaagatacatagtattctgggaaagtcaccggagtctttccatccttcaaagtagaaacatgaaccaagtcaccatacttaacaacacctctagcaacctcagcagcgtattcacgagttaggttgaactctttctccttatgagaggactctctcaatttcttatcgcacccttcgcgtgcagaaacggaatctaaagctaaagccaaagataacaacaaagtactacacttcatgactgaattattaatggctcaataactgatgtcgttatttggataaacaatctctccgcaagttgtaacccctaagctcatcgctattcaatcttgatagaaggttccttaaacctgtcgttgcctatatataaaataaacggtacaaaatttataatgcggtaaattacataatgcaaactaaggtaaggaaggtgctcagcctcaaacttccgaaaaagtagtttgtttaccagaagaaaacatttttgcagttcacccaagcctttgcattgagattggttcggacgaaccatccgcctagatctcggatctaagtttaatcgcagagacatcgccgcataaccacatcgctccagccaggtgtgtttttcttttgttcttatatgagccggtcctttgctgaaaagccagtctgaacgcaggcccaacgcacacaactcacacacaccctcaaatggaaacgttgaggcattgctaagtagatagctgctatgagccttgtttatgccaaacatgcttatacggttggctgagatccgaaattcctcagaaactagccattacttgtagtgtgaccttgcacggcacatgatgtattgaaacaactcttaagtctgtatgtacttcaatagatccgaaagcaggtggaaactgaccagtagcttgcatattgagctacggggagacttgacccaagtttatggtatcactccattttcatacacgtgaccataaatgaatttcttttcaccgcagcatgaacaaatcgaaaattttaaagagtgaaagaaaaaaaaagtagcgatgagatgagatgagatgaggttcaaatcgttggctttgcaatcatctcctggcgatagatttttgatcaggttcgacttgctagtactccaggcaacggcagagacgatatagaatgtcatctttacgtgatcaattagcgcaggtagcgcagaataacgctactgttgctcttgatagaaagagaagacaaaagttacattctgcgtctttggtttacaatccgaagactgctgctactcaggactatgagtatatatacgatacagcgttggaatcgtttcatactttggtgagtttggacttgaggttcaaagttttcactaattccttattcagtgcatcttccgtgaccattgatagaaacgttcaaacaaaggatcagattagagatttggataacgcagttaatgcgtatttgatgttgatttcgccgaaatggcatctaactccagctttgcatgctacggaatggttgattcgtaggttccaaattcatatccataacgccgaaatgcttcttctatctactttgaaccaataccaaacgccggtgttcaaaaggatcctcaatatcgttaagctaccacctttgttcaacccatttaccaattttgtcagaaacgataagaatccaaccgatttgacgttgatcaaattgtttaacgatatggacttcttgaagctttattcaaattatctgtccaagattatcaagcaaaaagttacctatacgaatcaactgctatttaccacatgttgtttcattaacgtgatcgctttcaatgcgaacgatgaagataagttaaataaattggtcccattgattttggaaatttccgcaaaacttttggcatcggattcaagcgattgtcaaatggctgctcatactatgctcgcggtacttgccaccgcattgcctttgaacaaaagcattatcattgcggctacggaaactatcttggccaatttaaaggaagacgatgctagaaaaaaagctctcgtcacaatctcaaaacttttccaaaccttgaaaggtgtaggtaatgtggatcaattaccggtcaagatctataaactcgttgataattctttcccattcgaatatctactacagttcctgagtaatgaaaacaaatattcctcagataaatttttcactgcatacattaggtctgtcatcagatatgatcatgataaattgagtcaaattgtcaaaatcttaaggaagattaagttggaaaaatacgaagttagatttatcatcactgatttgatacatttatctgaagttctagaggacaagtcacaattaatcgatgtttttgaatacttcatttccattaacgagggactagttttgaaatgtcttcaagcactaaacctgaccggagaagttttcgaaataagattgacaacttcattattttccgtcaagaacagtgcggaacaatctggtgaagatatcattaaagttctagatgatgctaaagcatcaaccgcgaatggttcagctgttccatttaaagatttcatgaccaaaaactcagagttcatctccactaaagcggagtctatgcttcttgttaaagatgaaaagtttgtcaagctgttgtcattatttgtggaagctgtaagtaaaggatatcaaccaggtctatttttatcctccttcttcactactttagagagcaggataacgtttgtgctcagaatcatcgtatcccctggttcgcctgttgctctcagattgatttcactaacacagttaagcaaattcatcaatggtatagatgagcaaacggatcttttctctttggtacctattctagtgacagcattgatggatatttctagatctgttcgttccaacacgaaaaaggttctacaacagatagccaagagacctttcacagcaaagtatttcctatctaacgtactctacggagagaatttaaaggtgccaatgttaagtccgaaagatagcaagttttggttgaccaactttttaagcgattacatcgttgaaagtacagatatttcatccctcgtcattccatccaaaaatgacatggtatatatgctgttttggtgcaaccaggcactgcatcttcctctcgcctattcgaagactataatgttaaagctcttgaccgctgtgccacaatatgcttttacatattcaaaggtgttcgaacaatttatggccacatacatcacggaaagaagttcctgggaaacgaagtgcatcaaaaataaaaccaatttcaaagacttcgaaactgcggtatgtgccattgttgcaccaaaagaaaaaaacagtttcgcgatagattttttgattaactgtttggaatcagaatatgaacaactttcgaatatcatggcagacagaattttatctttgtatccaacattgaaattcccaaaccaattaaaaattgttcagagtataatagactcctcagttgacaaagaactatcatatgatggtctagaaacccttcaaagtcttccattaactgcagatatttttgtctctgtgttgaaaagtaataccataaacagcgaagatcaaacagatttgactaaacgtagaagaagaagatcgtctacggttaacaagtccgccctacagaaacaagatatttctcaaattgccgaagcccacctaaagaaaatgactattattctggagactttggataaattgaaggtaaagagtaacgaaaatctattgaatgccttattcaaccttttgtccgacttggaaactttagaccatgatggtggtttgcctgtactttacgctcaggaaactctgtcctcttgtcttttgaacactatttcttctctaaaatctaacaacggaagtatgaaattaccctctattagagcagatatactagtcgctgccattagatcatcaacatctcctcaaatgcaaaataagctcctattagttgttggagcattggcttcagtatctcccgaaactatattacattctgtcatgcctatttttaccttcatgggtgcacatacgatacgtcaggacgatgaattctccactctagttgtggaaagaacaattagtactattgtgcctgcattattgaaatcgacggaagttacgaacaaatctgacgaaatagagttccttctaatgagtttctcaactgcattttcccatgttcctaagcacagaagggtgagtctatactctactttggttagagagctcggaccttcagatgtgattgctccattcttgttcttaatagctcaacaatattcgaactgcttggaaaagtttaaaatcgctgaatctaagaattacattgagttctttaaagcttttttgagtaaattcgatattcttgaacaacttcacggattcaatgagttattcaatctagtcgaacttttagacgaggacagctcaaagaatgaggttgctccaacgaggactttattctcaaatggtatagtaaacatgtctaagtcggagctctttgtgttgaagaagaacgatcttgatttcattgataaggtcattggagagagcaaatctgactactataatacatctagcaacctcaaattaagaatattgagcacattgctggacccaaatattgagattgaggtcaaaaaccaagtcagaaatgaattcagtattcttttgagtaaaacattaaatgcaattaacatgacagatagtctttcatacgataaacactcatctgcaggatctaacgatgaagaagcgggttctgaaagcgaggccgaagtcgaccaaaaagagttaaaagacattttgttcggattattggaacacgtcctagatttgcttcctattcaggacttcgtcgcatctattctacctctactacaaggaaatacggatgagtccgttagacatcatttaactgtagtgacatctaacaagtttattgaggaacccatggagtccttcgaaaccgccaatgagatactaagtactttggtggaaacaacagagaaagcctcagaatctacccagattttacaagttactttgaacaccatcagttcaattgttaccagatttggtgataggctcgactctcatttattggtgaaatcgatggaaaacagttgcaagcaattgacttccaagaagatcgaactcgagatctcctcattaactgttctcacgactctaatccaaacattaggtgtcaaaactctggcattttaccccaagattgttccggtcgcgatttctatattcaagacctaccaaaatgccaaaaataaccttaaggaacaattgcaacttgcaattgttttactctttgcctctatgattaagaagattccaagcttcttattatccaatttacaggatgtttttgttattcttttccattctgacgaggtcgctgattctgttagactatctgtgatatccttgatcgttgaacacattccattaaaggatgttttcaaaacactgcagaaagtatggacaaatgatgtatcaagttcaaataattcagttgctgtatccttatttttgtctatgttagaatctgctgttgaagctattgataagaagtcggcaacgcaacaatctcctgttttcttcagattattgttgaacttgtttgaatacagatctatttgtaccttcgatgagaattcaatcaaccgtattgaggcttctgtccatcaaattgctaatgtatatgtccttaagttgaacgataaggttttcagacctctatttgctttggtagtaaattgggccttcaatggtgaaggagttacaaacacaaacatgtcgaaagaagaaaggctaatggcattctataagttctacaacaagacacaagaaaacttgaagtcgatcatcacatcttatttcacctacctcttggaaccaaccaacaatctactgaaacaattcatctcgaaggagaccgttaatgtgagccttcgtcgtttggttttgatttccttgacatcttctttcaaatatgatagagatgaatattggaagtctacctcaagattcgaactgataagtgaatctttgattaaccaattgaccaatgtcgaagatgtcattggtaaatacttggtgaaggccattggttcattagccacaaataactctggtgttgatgaacataataagatcatgagcgacctaatgatctctcacatgaagacgtcatgcaagacaagagagaaattctgggcggtaagatctatgaagttaatctattctaaggtgggagacggctggttagtattgttacctcgtttggtacctatcatcgcagaattgttggaagacgaagatgaggaagttgaatacgaggtaagaagcgggttagttaaggttgtcgaaagtgtaatgggtgaaccatttgatagatacctaagttaaagaatttcgaacgcatttacgtcactcaatcctcgattgaccggctgcgtgtataatacaatcagatagccatgtctcaataaaagataagctgtaaataaattttgtactttaaatttaaaactaaagcattaaaagtaagacatatctataataatataacaggtcactcagtacttccttacatactaagaaaagagatttcatttctgttctcttcgatctttcttttccttctccacatactaggagcacatcttcaaatacttctcactgttttcaaatatcaaaattaagaaaacaagctaaagagaaaacgaacgatgtcgcactgctagacagatttctttttgcagtcactggtggaagagaaacattctctcgacgtcgtagtcccttaggtgagccagcaccgataacgaagcaatgtccgatcttcctcgtacgaattatgacttcaaacccaatcgtgccgggggagtagtcccaatggtaatcaagcgattattcaaatcaccgaagaatttagatttcgagacagcatcatgggagatgttcaatttggtttttaaaccgagaactgcatttaaatcattctattacaaacgtcagacgacagaatcatgggctagggatgatccttcttttttcattttacaaattggtctgcttactttaagctcgatggtttggtctattgtttatggccacagcttcacccaatttattaagatgatgaccaacatgatcattatagatttctttgcatttggagcattcatggctacatttttttggatcatattgaatcgttcattttttaagtttagaagtgcgtctagtgcaagcgttgaatgggcttactgttttgatgttcactgcaatgcatttttgattatttggtgtttgctatatttcttacagttcttactgctaccgatcattaaactacatgcttggatcagtctcttcgttggaaatatattatactgtaccgcgttaggatactatttcattttgacattttatggatatagtcagttgccattcttgaagaatattaacttcatacttttaccaagtcttctgatggcgttactcttccttctaagtttattcggtatcaatctagctgacaagttcagcttttataacgaagcctgatgtaacatttatgaaaggttttgcaccgtaacttcagatcaatggaaaacctaataaaaaggcatcttataaataatacaacagattaaagatctcgtcaatgatacgtaataaataaaacccaccttatacatagatataatgacgtttgaactaaaataggaatagaatacggaaccatcaagtatttctatactgtttatcaaatgatttatcagagggtgttgatgctgacagaaagttaccgtttgtgagatcacgagtaggagactcataagctataaactcctttctctctgtatgatgccatatttcttcgcacgactttttacccctcacgaggatggatttcagttcaccatctttcacagccggaaagtcatcaaaatgagttaatgcatctagtgatacgaaattctccaaagtcagcgaagaagtagaatctggagatagctcccgtcgctgctggaaagtcgagttcttcccattagacttaattctagcaggttttttctctcttttctttataatgttgctcattctcgacactaagatacttttgcagttatagttaaaccgttcgaccattttacattgcaaatttaattgctggtacattaaattggtagaaaggtctgaattaagccaaaatttcccctgtgcagtgattttccaaacatctttctgtggtgatagcgaattgttcgaaacgctggagtctgcagagtggtttaacagataaattatatcatctgttgcatgaatagagtttcgagtttcggctgatttgtctctcagatggtctaatttcaattgcgttctagaagtataatttattgaaggcgtattgtttgtcaaatcagaattgaactgtttcaaggtcaaagaatcacgtcggcttatggaattagcaagttcaactgcagttcctttagtgaatggtgattggtttgaactgatgggactcgggttgttcatggactcaatcgatttattagtttcgaacttattctctagcgtgtagttctcgttgataggctttttgaaagtttcttcagcagtcaagtcagttatcacagctggaactggttctaacggagaattggttcgtgacgaagaggaagaattactattggtgttaacagtcggtatgcaacgagcacttgaactctttggtcgtaccgcgtaggtcttctggtattcgtatctgttgatgggattcgaaaatgttttcctcaagggttctccagaggatactctgctcaatgcagaaacccttctatctttctggtcagttagaactagacattgagcctgagattgtttcttgtttctgatggtatttaacaactgatgagaagagctagtcaaatggaatcgatttcccttctgtttcggttcgctactcgtggggcttgtcccctctgttttcagctccggaacagtgtataagcttttggtagttttcagtgacgactgtctggaatgcttcaaatgggtatgattactaccctgaagtaaacaagaaagctcactaaagcttgttttcttctgtgttgtgttcatcgattccatccatgctgtttctcttgttgtatgtcaaaatgagtatctcttaatggtacacttaaaatgaaacgcacgttgtcaaaagtataagtcataccaatgccaattagaaactagttgttcaccagtttatatatatatatatgcgagcaacatttgtaccctgtgtccaacaatccctttaaattatctgggcaattgatccacgaattcaatgcaccgcatataatttggtgataactaatagaaggagatgcagggcccttattctcgtgatgaaatttttccctacattttttttgtcaatttcaaaacgtaatggataagagatgaacacgaacatacacagatgaagataacatcagatctgatcgaagtcaaccaactgctgattgatatagcaacccatttttattgttccttgatttactgccattaacgtcctagttttgccctgagggaaagttcaacagttcaactggtacgtttgtagtaaaagccataatcaaagggaggttaccactacaattgattctacgcctgatctgttcctacctgataacgatcaagccaaacttttcaagcattttcgtcgccatatgtcctgtggttcctctcgaatcaaatcatttcttgcgataaggaaaaaaaaaaagtagaaatatggtgaagtgagattcagaaaatgacgtagcgtagatgttctgtaagataggtaggtatagaagagtgtattcatcgacgaattcggggagcaagcccttgttacgacaagtgggaaacggacttagtatacggaaatagatatggcagtaagtaggcaagcttaagggaagaagtactggttgcgtgatgtttcgatcacgtgcattataactttaatcctttcaaacacgaataaatcaatcgtatatatcaattggtggtaatctatcgacgttgtagaaccagttgttagattccacctctttgcagagccagtccactgggaatactaccaaatggccatgtatacgttccaataatttttttgcagtttcacgatcgaacatacggtctttcgtaccgtaaagaagctgcgatgtcattttcatcttgaatatgttgtcagtagctgcatgttggttattatattgacgatctgcattctcggagtttttactttcttcgttggatacagctcgattaccctcatcaacgctgtccattgcaatatcgctggcagatagttcgaaaagatgtttacccttttcgagagtgacatttgtagattctacctcgcttggaacgcgctcaatggcatccatagcatcatgagacgatgctataacagccggtgttttgcctagtctttttctctctagttgtatggctttatcctggtatgaatcaaagcccttgtaaaacgtttggaattccttatactcccgccatgtttgcactgaactatccggctggcaatggaagaccattctgaaaagaacagtgttccttaaagcaatcgtaaaccatagatcctgagaaaaagactcgcataatggatcatcgaactgatatggatcaatgtattgagcagcagatagattggaggtttgctcgctgattggtggtagcatttgtttaagcatcccttccaccatttcatcgtccaattgacctttgtcggcaaagctgtcttgaaagttttgagttctgtgttttgcaatggttacgtcaccattttttttaacttcgtacaatcctttctccttcttgaaggacaggtattgtaggtagcacaatctcttcaaaagcttccatttgttcatatatttgacgtgggaactgtttaggtactcttccacatttgccctatccgggagaatggatgaaaatctctcgtttgtggctttatctattgtattgttgagaatttcttcgccccaggcctttaattgcttggaaacatcgttgtaaatagctggtttggaatcgacattcttccaattgtctggaccgtgaccatctacatcgcgatcgtggaaggagttatttatcaatcttgaatcagaactgatattcttcttatctcttatgcccctatttgcttctccagcacggtaattaaaggagtggtacgcagacttaatatctacatgaacatatctgtttttttttctttcaggaagaggtgcaggcttgttgtcatttagcgactctcctaatttatcctctgaattgtttgctgtctgtagttgttgaattataccaaaattttccactgtatcttggtatttctcgtaccattgaggactatgtttttcgttgagaatttctctaaacgctagctctaccatagcactttcatttttagtggaatccttcattttactgagtgcttcgagaggaatggtgtttaaagtatttgaattcaattgcgccataattcttagtttctcgaactttctttcgataaattcaaccaagtccacatcacatcctagatgttctctcatcaatctttgtcttaattcgaacgggaatctaccagccaaatactcctttccattcattctggattcaactagttctttatctcttacaatcacggcaacttcactatctctgttacccaacatagatctttcattgatattggcactaccgataatacagctacggtcgtcaactatcataactttagcatgcacataaagttgttctgtcactagcttatcatctgcacctattgttgaccacttccttaatgaatagaattgaatatactggataggatcaatatttaatttcttaagctttgcaaatatcgacgtttctcctctggatattgactgatattggcattgcataataactctaacactagaaccctcagcttcatccacctcagcgttgaaaccaggcattaatggaattacaataaaagccatccaaggttttccttcgctattggctttgacaattctgtccacaattgcatcaccaattttattttcaataactacaccatcccaactagagcttgtcacaaaaaattgattctcgatgtaaatatagtaatcagacgtttctatcagcttcaaatatgcgttttgaatcgaatgctctgtgtctttcaatcctagtgaccaattacctgcacttctgattacctgaatttcacaagtggattggtctttaagttcctggaagaaatatgagttctcgagttcatcttttgtcaaatctgatgctggagttagtaagggagtaggtctactaggacgtttttgtcgtaggaggtaattccatctttgggtaaaatgtctagacaaatctcttgcgggctcaccaactgtcatcatttggacatcatgccaaggcattctaggtaccattgatctgtcatacatggactggaatggcttatctaggtcgtagaagtcgcacactcttgcattggaatagtctttaccaggaaatatctgatcttctaaatccgtttgttcatcatgcaaaacatggtctggagtatcaaatctcccgtaacataaatcaattcctcccacaaatgctacagtattatcaataactgtgaacttctcatgatgggcccagaaatatgtattttgtagccactggtttggagatctgattacatggatattatgatgtaaacttaaaagcgaatgcttagtccaaagagaatctgttccaactgtcgaaccaacatttctatagacaacaatgaagattttgacattctgctctgctttttctttcaaaatacgatcgatacgataattctgatttcctcgcacagggcgtctcatatataattctggagataaccaccaatcgtggatgaaaataacatctttagccattcttagagcttcgctcaatgaccagaagtagtctctaccatcgaccaagaatttgcaaaaacagttttgtctgacaggagcaaaactgtcgaatcgatacttttgtgaccagatcgtagacttcgacatatctataattgattttacccaaagtttcattaagtattcagatttgacaatcatctgcaattttcgctcactattctctaaagttatcagcaactttgtggatattttagattttaaattgtcatgttgaaatggatcgaaatcgatttcttccaagtcgttggtagaataaccagaacatgaaattttaaatttgctatcaacaaggaatacgtctagtggtgttgttgaatagatgtcactcacataagtgatatatgaatgccttaccagaaaccatttcgttgtatgtctctcgatcatagccttgaaatcgttaaatttaaaatgtgaaacacgccagccttgtgattttgcagtcgatcttattaacatatatccttgttttccatggtatccgttctcatagcttaataatgtaccgataggagacatttcgtaaaattggaataatctattggcttgcggtctcaatgatagcgccacgttcaagagtttcaaatatctttcaattctgtaatgcattggcttgttgctatcatcttgatcctgaaacaagggtcgcaagtgctttgactgatacctctcagttgataactgagtggaagatcttggagtaaaattcatttcgggcggctcatgatttccagcattactgttgaaatttttttcatttgacatgtctcttttcttcttcaaatgatcgtcgaatctggggaaatgaggcaaatgcatctcgctgtatctattattgtcaatgtaaaatttgttaacagtattttgttgaaaagaagttaatttcaagcgattatgaagggatgccacatctttgtacgatcgtactatctcccatttcaaacgattttcaccgatcccgtattccatctccagtagatactttgtatgatatccttccttaaaattcggattatctggatttacagatctgtctgagtgcatagacgaggcaatggataaacgtcttctgatattaggacgagaattctctggaattggaagaggtttaacagatattgatactattgtaagaagcaaaggcgctctagtgaccccattatcatctttcataaaaatcgaacctgctagtaatgcagcaggcgaacctgccagcatagtatcgacgaaatcagaggccatatcctgtatgtaaacgtcatgttcgttcatagtttcgtgtgttgcagtggattgttctctttcgccgattcctggccattgatttttggtgacgttagttaatttcgatagtcttcttattgcttggccgaactctttcttccaaaacatgtcttgataattccttcgaaacttcctatttccctgaaaagcactctggttcgtttcttcaacactatcatgctccacgtcttgatccccagagtcagttcttttgtcataaacagaggaatttgggacccccataaacttcaaattcttaacacttgcttcaaaatcagaattatgtgtatcttgatcagtgtttgctctgttttcagcagcactactctcggcatccgtataactttcaccatccattgattgggaactagcctcattcaatgttctgcttggcttttcaagtccattttcagatacattctgcatcgaacctggattccttctcattgacaactctccagcctcatccttaattccaggaatgacctggccatgatactcagtatcctggagcattttctctcgtttgcaattcttatatcccctcacactcaagtaaagtaatggcagatatattactgcgcaatgatttacactaaatcatctctcttggaccaagttttgtttcatgtagtgtgttatttatatctgtatttattttacgtgtgcatttatgagggcggttgcagtcagacagaaataactaatcacgtgatttgtatttttttctttcgaaagaagaacatagcgttgctctgcctttatatttttttgggatcccccagaactttatatttgggtcggcccaaatctggttaaccacatagacgtgatacaatatatgtaaatatacggtaatggtacatcgttactggagaaataatatttcaccattgctgccttaaagtagccagcagtgcacctttcgcgaacttatggattgtccgaataccagttccagccccttcactagatggaacttttcaggacctacattgtacctacattacaaacaaagcgtgcacgattagggatacattgacacattttaatcagtatccaatcgtaaacaagaataataccagcttttctagaaaaatactacccaagtttcagctcaacaacccagactcggttctccagctccatagattaagagaaacttccttatcgataaagatatcccgcacgtaaccgatctatagttctgggtggtcttttaggtcagtcaattccgtggccttatcaacgataaggaaaaacgaaaattttgagggaaagagaaagagagggagataggccaagaacatccatattacccggatgcattagatatcatttctacgggccgttcttggttgtttggccgaaatattattgttacccggatttatcatcgattacttggaactggacattacattcttctgtagtagtcctggaagtcatgatagatttccagcactagctacaagccacacgctgaagatattgcattctatatttcatgggttctcttatcgtcaggttgagccgatgatcaaaaacagaaaatatgggccatcgaaaaagatttagtacagctgggtctaccatcttatctgtacgttcactcatacctgctgaaatgtgtcaaatcttcagctacttgaaaggcccgataatctatgatgacagacacaacgtgtctgctatctggatgtgaaaaattccagccatttctgtttcctgtctcgcttgatatcaatattggctctctttatcgcgaatattttcgttcagtatatatttgcatacatttttttttttgggccacctgtgatattttaaatttgtacctttcttatctaacgttgagcatttttagctatatactcatcttataccgtcacgttgggtcaaaaggaacacaggattgcattagactccatataagattggggtcacttgggtttcagcttagtctcggctttatcataagctcatcgtcgataaaacccttctaagagttgagaaaaaaaaaattcatcaccacatatcaacctgtgaagaagatctgagtgtttggaaataaattatctattgaagaattttcctttgatctcagtttcttgacaagataagcgcctttagttactagttcagccttcattcccataccttcgctagttccgggatttacagtggcattgattctatcagctacaaaacgtactgaatattttggttttgttttaatcacttggttaaatcgaagatcaaagaagtagtaatcgaaacaaaaaataaaagagtcagctttgtactgctccgtcagtttcagtttacgacacataccataaacccttgctactttattctatattttggattgccattctataacaattcatgcttctgagaaacttgttatcataaaacggtcatttttaagcacagattgatgatcagtttcgaagttcaaaagaataaagtacgagattagcttttttgtttgaattgagataagagcaacctatcatttgattgtttccgctgaagtatgacacttgaagaaaaaagtagtaccgtgattgcggcggtcaatcagcctgccgttttatccgatagtcgtgatcagataataaacgacatgaaggaacagaaaaggaccgatcctgttgctgttttgtatccagtacggtccaatgattccagtgcaagttctagtcggaaaagcggctctgatgctcgaaacatggatgatacgataaaggacatcaaaccgaataatcctgcaagcaaccctgtctgtaagaactgttatacgtcaactacaccgctctggcgtagggatgagcatgggtctgtcttgtgtaatgcatgtggtctatttttgaagttgcacgggagaccaagacctatcagtttgaagactgacgttatcaaatcccgtaatcggaagtcatctcatcacgatagtccgaacgacaagaagaggaaagaccccgctttgctaacaccgaacagttctacaaagaagaaaaaaaacaatgcttacaatatgaataatgacattgttacacagaatgacaatgcacatcaaaaccaccaagctcagacttctcagcaatttccgcagccattaacaccccaggtcagttggcaaagtcaaaatgttgagctctctgaggatatgaagttccataaaatcctgccaaagaataaccagggcaaaggcaacccactgccacatctatccaacattctgtccgtttctagcgctactcccatgacaggtgacttcccaactccaaattcccctagattatcacatttacacagaccaccgccacatctagccaccatcaatgagatcttatcgaatagcaacgctcaacatatgtctcagacttcacctccggcgcagtttagtcaatcaacagttgggaaaccattagacaattcgagctctaatcatcagcaacaacaaggcactcaacttccaagcatcatgagtaaccattctcaacagtcattacaaaacactgccgtactacctcctgctcagctgccgctgcaacagcaaccacaacctcaactatctcaaccattactgatgcaacaggaaagtaaatcttcatatttttctacgtctcctcccccgctagaactgcagcacactgtcgctcacagtacgtcttcatcatcaagtaacctgcattttaattcacaatctcaacaacaatcagttcgccaacaaccacaacaaaatcaacgcccacaagaatcagctgcgtcgaaccaatgtacgcaatcgagcgctaatgttaccttgtcaaatgatatactgaataattcacatcctccaacctcgccggtaataaaggaagaatctaaaccctccgtatctttgattctgcaatctcaagaagaagtaataaaactgaaaacaagaattagcgaactagaactagttacagatctctacaaacgacatgtctttgaactcgattcgagatgtaaggcattagaacaagaactcctatcagttcatcggcaacaacaaaaacagtgaaatttcagctgtcaaattttgacatgtattcctatccactgttatttctgttacgttaaaacatttaattctcatggtatgcggtacgataactatatagtgtaaatatctatacgcgtttcttacacattttaataagcatagatgacaacatatcagtccgcgtttgactatcccatctgtcatatgcaatcgctaacggattcttccaatactgtattattggtagggtaacactactatgatttcttgaaatcgcccttctatctctcaacttgaatttagaagagagagtggattaaggatggagttactattacagtatgttccagaggaatacgacgtctggtcccggtgaaacaggatcataatattggaaaatacgctttgagacatttctatactcgaaagataattttattcgtacgttctaattcggcatcatgtctcgcaattctatgaacttggagaatactttatttcaattgaaattcactgcaaagcagttgaacaaacaagctgccaaggctgccaaagaggagaaacaggaggttaataagctcaagaagataataaatgagagtgaagagattggtaaactatatgcgtctaatgctatcagaaagcgcaatgaaagagtccaactcttaaaattggcatcaagagtagatgcagtcgcatcaagagtacaaactgctgtcactatgagacaagtatcaacgtctatggcacaagtatgtcgcgggatggacaaagcacttcagtcaatgaacttgcagcagatcacaatggttatggataaatttgaacaacaatttgaagaccttgacgcaagcgttaacgtatatgaggatatgggagcgaacgcagatgcagttgtagtcgatggtgataaagttgacgaactaatgaatcaagtagcagacgaaaatgggctagagttgaaacattcggctgcattaactgacttacctgatgtaaaggaagcaccggctgctgtagtcaacgaagaaaaagaggataagcttgcagaaagattaagggcacttcgtggttgataatagtgttcaatatactattaggaaactctaagtaagtagtgtacatggtatattaattacaggatataagtaggaagaatttaacttattgcattggcattggcattcctcttcctctagcaccttgtggaggagccatactagctcctgcagagtcactctctttattcttaatggtttcatccacggacaaaatcaggttggtagcttcagtagcactgcttagggcattaatcttgactaaagcaggttcccagacaaatttgttgaaattatcaccgatggtttcattgtcaaaatcaacaccataccacttctcacctttactgtgagccattcttagtctgttcaagatttccacagagtcgaaacctgcgttttcacttaactgtcttggtataacttctaatgctttggcaaatgcattgataattaattgttgtttaccggcaatggtctttgaataatctcttagatattttgagatttccatttctatagcaccaccaccacctactactagtttattttgtagagcccttttaacgatcataatagcatcatgtagggatctttcaacttcagcgataacttgttcagcaccacctctaagtagcaacgtacaggttttagcttgtggacatcctttgaaaaggttgtaacgttcagaaccaatttgcacttcttcaaacagttcacaagttcctagatgttctggttttatgtcagaagtggtagattgcacagagcctccgacagcctggataacacggttcatatcttcagttgcgactctaccggcacagaagatgttcctatcagcaaaatattgagtggccaagtcaccaattggtaatttagataaaatgatgttggcacctgtgtcttcaatttgttgtaacttatccaaaatgatttgccattcagcatcaacgatagcttggtaatcttcgacatgttcaactctcacttctgcattatctttttctgcctttagttctaattcaacgtttagagaaaggatcttaggattcttgaaagtctttggttgttgttcgaacccagcgtacgagaaagtcttttggaaggcgacaccgtcaacgaataaagaatcttccatagccccaccagaaatctttttgataccaatcaatttatcatcaagatcttcttgatctaatgttaacactgcatccacacacatcttcacaaagaaatcagcgttattattgattaacttagaggacatcgcggttctagcacaacgttctagcaaatctcttgaattgttttcattggaaatatcaaccgcaatttcattgattttagctacagccagttctactgcctttctgtaacccttcatgataatatgagaagagattccttcttctaagaaaggctttgcttccttcatcaattcaccagctaaaatggtcacacttgtggtaccatcaccaacttcagcatcctgagctctggaaatgtcaactagtgtcttcgctgctggatgaacaacgtctaataatttaagaattgtagcaccatcgttggagatagtcgtcttaccgttagatgtcacaatcaatatatcagaacctaacggacccaaagttggtttcaacgtatcttgaattgccaaacaggcattgatgttagagatgatttggcctctaccctgggaggaatcggttccctccttaaggacaacaatagtaggtgtttgattgccaaagttcattctcaatagctccttggttgctggtgcaatagctctgttttgccacccgatgaacgaatatcgtaacaatttctcgctgtgtttgatttaaaaacagagtagtaattaattttttattaaattcgatttcgttgaaatttcatataaaagtaacaggcaacagtaatattggaaaacaaacgaaacaaaaagagggccaaactagagtgcgtcttagtaattggtgacaaccaggtccactttatatagaaacaacagagagtaagacggtctctacagaagataatatttgagttgcaccggtatatttagtgacggcggcggttaacgcttttttttcctctctgaaacgtcgttgaacgctgaaacatgcgcgtagcaacttcgagatgctgttttgcatgaacatggacgtctttaacatcttgaataatttgtataccgttgtaaagccatatattgcaagtgattattctaatataatctctttatgagacggtatctacattatagtgtggacattctcaactaataatcacgaaattggttgtgtggccgagcggtctaaggcgcctgattcaagatacctatcttaaccaaccttacagttgggaacactcaggtatcgtaagatgcaagagttcgaatctcttcgcaaccatttcttttttgttaaatcttagatttttttggcttggaagcatgtcttgttagtggcttgtagctagaaacattctactgcacgcgaaaataactagcaaggtattatgaggatggtctttttatactagtgagttatatacaagtgatcacctacattgtatgctaattatttttctatttaatttatggggaatagtgaagaatatttattatttttgaagtaatgtgccagatgacggcaaatgtcataactctcatttcagctgaaacaattttgtaggtctaaattgcccaggtgttgatgtcaccattcgagcgcccttctaccaaatatccgtgtttgtatctaacaaaatccacgttaccttgttcaggatcatcttcgccgcagaaccagtggttaccgtctttcctgttgtaaattttcacagtaggctcattgtttgaaattacaatcttatccagatcgaaatgtagagaagtgatcggttgctcatatgcaaatacgtcagaaagtataccagttcttaagtcccatattcttatacttctgtccattgcacctgtaactagattgaccgagtcgaactgaagggaggtgatggcgtcagtatgaccttctaacatacgtactactttcccggatcttaaatcccaaagccttacgataccatctttagtacctgtcgccaaggcagcatcgaagcattgtaaagctccaatagccggcggttccttggttagaagtacactattacgaagagggatgtttctttgagaccgcatagggccagttgcgaaagatatatctatggtttgggtgcacttaccactattcagatcccattgacgtactgtcctatcctgagaaccagaaaccaaattgtcaccgtcaaaacttattgcggtgatttcatcaacatgagaatcaaaggtatataaacatgcatcattatcttcagatgaatttgacgcttcatcagccatggccttatcgatatcccacaatttcagaactgcgtcccgaccaccagtaatcagggtgctatattgatcaatttgcatgcaactgatagatgctaagtgtccatgcaatgtagcaatttgtttttttttacttaaatcccatacttttaccgagtgatctagactgccagcagagcacatagtaccaaatggcatatcaaaatctaggcaagtgatatcttcatcatgggccttaggaaggcttgtaatcttagatccggaatcatagaactgttgtaaagttggataagttttacggcggcgattacggtgagaaacaccaacatctttaatttttttggaagtactatgtttcttcctttcggaaatatccgatttcttctcgtggtcttgtagctgctgatagatggatttggaaagcaatggagagtgctcttcttctttgttttctaaaggagtggtagccgcagtttcatatgtttcgttagtttctccagttttaggcgaaagttcagataatccatttatattttcttcatcctccgatgagtattctttatccatgttgtactctataatcatatcgattctatccttaacgttgttcaaatgcttctccaaaaacaattcatgctgctcaattttagccactcgcttgaatactagttcacgcatcatttttaacttttccagcttgatatctagctctcttatttcgctagctgctagatttttctggatttcaagtaaatccaggttatcggtgattgacctcgaggcatccttcaagaaggatgcggagtaagaatgcagaagtttatcagcttttaaatggtctggcaaactaaactcttcctcttgttcttcttcttcagcgtaaactgggatggactcagagtctgttaagggtttcatatcgctattcattataagtttttgctgtagttctatcgtttcattaataacaggtaaagatgcttcaaatccttgaaataacgtcggttcttgcttttttgactttgcagatcttttctcgccattttctgttatcatgttcttgttctgaggtatagtgtctcgtggggcgtcttcaagtagatcatcactcaagtaacttaaaactttgaatgttgtttttggatcactataagagtttttaaagaactctttgctattggaatatatatcttggaaacctgtattcttgcctttagataatttcacgtcgtggcgtactttaactagtgatgatcccccacctgcattagtaattgtctcatgaagcaatttcttatatggactactgtatgaaagaattgtgtcttccatcggctgcgacgagaatagaacagacgccgtggtagacagtgcctttcccagattggcaaactggtctcccgtattagaactcatagttctggcaccactaacactcttatcgaggcttttgctcgcaacatatgtttctttaagatttgaagttgtaataggaactaacaactctttgtttccatgtatctacttttttgtactctgaaattagaactttcattgcagcaataaaatcatatgaaagaacgaaaaccgtattctctgtagaagagcaagatgccgtagaaatggaactacgatatatttcgttatcataaaattagaaccttaataatacaaaaatgatatatactgaactgaaacttacatgaatatttccattccagtgcgagattaattcccgaagtgtgaaatatatctttccacttcatttcggcaagcatatcggtttttcttggatataacttattaatgtatcaaatggatttttagtaccgctgctagatttcacttatttctcccttccaaaaggtccaactgtttctcgagcttctgtatttctttctcctctttatcgatgagagatgatattgacgttttttccggtaacgcttcgtgttggaagtctaactcctggatctctactttcttctgaagttcattaatatcagcttgtaatccattgtatatttgcattagtttttcaaatttctccttgtattcagtgagaggccattgatctataatttcccggaacacagataatataatcgagattgggaaatcttctacgaaaagagttttccttcttgatacatcctcgccagttatcacacttccattccgcaatgcatgaagaaattgcttgatttgttcgtccttgctgaattttttcaatagcacgtcgtagattcccagctcatcgctgttacttccttcgaagataaaatctcttgcaggtttctgtttctttcggatgacatgatcgttttgactgagataaaaccccttcggtatgtaggtaataggtcttggatctggtaaacatagtgctctgttccgtttcaaagttgcttccctctccaagagatgatcgtatatccctactttcccatccttacgcttcatatttccatcgttatctgtactgtataatgacatttcttcaattgaatcgccatctcttataagctttactataagatctgagtacactttgctgttgcctggtacaatcgcatttctaaagatgcctggcggtttgaaatataaggtcgatattgactccgcggattttgatatctgatccaggcagtaatctaatgatccagacatcctttgatgttgttaaaaaacactacacgtacagattaggcaccaccctctttcaggaaactgctatggaatacaatatttcatccaatactatgtaatttcttgaaatactccaaatgattcatttatcttttaactcgattatgtttacattttagtttttttgttttcggtgtttacgaaatctttacgtgaaaagagttggcattatgttaatggaaaaggttgacagaagacttttaaggctcatgcggcctttacatcggggtaagctaagcgagaactattgcttactttattctatatatgatgataaataaacaagaaaatcagaattggctattattattctctccatgcgatataaacctcatcggttctaaacttctgcgtgacaatggtttcagaaagatccttaacaaagtggcctgttctgtactctaataggcctgcctgggcaatcatcacaccattatcaatacagaatctgtcatcagttgcgtgtacttgtccattggacctgtctttacacatttgggccatcatctcttgaagcctaacgttgcatccaacaccacccactattagcacttggtttgagtttacatgggccattgcacgttcggtaatctccacaagcatggcaaataaattttcctgtaaagagtaacataggtcttctacagtcacaagctgttctcctgttcttgaatcaaataataatttattcttcaagttctttttgaataggtctttcgctaaagtgtcaatatattgcaaaataccactcattgacagatccattcccttaacagtgtatggtaataccactaatttttctttattcttacactgtttagccagttgttcaatgttgtaaccaggcgatggtgcattcggtatcttcaaagttcttgcaaatctgtctaaacaattcccaatggcgatgtccaacgtttcaccaaagattcgatatcttttctcggagtaagcaataacttgagtgttacctccactaacatagagcacgacaggatttttagctcctgtgatctctctccccatctcgatatgccccacacagtggttaaccccaactaatggtatgtcccacatcaatgacaaagtccttgcagctataaccacacaatgcaaaggagcacccattccaggtcctctagtgaaacatatcacatcgatctttgtgggatcatcgatcttggcctccgttaatgcctttctaatgattcgtaccacccaattcctatgatgtcttgcagtatctcttggtaaaaacccttctcctggcggtgtcacatatgtatctctaatattagccaatatttcaacatcacactcatacgaaaggtcactatcttcatgtttttctagcactgggtgcttgataataccaacgcctaacttgttggcagatccttcaagaccaattgccaaataatagttccttttacctcttggtggaatgccgtttaaattcaccatctcttactgaaaaaagaatttttgacgataataggtataccttcaatgaatatcgcacgaacacacgttgaactggtgagacacactatatattcagggagttgtattacagatcaagatagtcaactcatctcagttcaacttttcggttttctcagattccaatttttcaaaaaatcatatacaccaattttgtgagtaaaagatagcatagtaagaggagcaacaacagaaaaagtgtatcaaactgcaagacatagtcatagctggtcaatcactcgttgaggggaaaagattgtgtacagaacgtattttcagattcgatatgaaaaaagatctccgcgacggggaattgaaccccgatctcgcacgcgacaagcgcgaattctaaccattaaactatcgcggattttgaaataaagcactcacggtgggggtcgaacccacaatcttctgattagaagtcagacgcgttgccattacgccacgcgagctatttaattcgttgagttgcttgaattccctttaatttatgtacggaagccgaaaccacgtgctaacaatgtgcatctttggataatttattaatggatttcaccctttgaatcaacgcaaaaataccttttattaattgcaaccagcggaaatctttttactacgacagtgaaactccctgagctaattttatctcattagcctctttatatttatcattaacaacagaatgttataaatacttcttcaatatatgaattaattgccattgggcaattaattgggggatagtataaactttcagcaatgtttgataaaagaccttctaaaatacgtacaccactgtgaggtatgaagcctcaatctagaggaaggagctgaacatgcaaatcagttagcaactgaggtcttcaagacttcattcgccgatcacatgacattcacagactctgtggacacctagaaaagttttctgccaaaattgcgagggcgtgtggtctagtggtatgattctcgctttgggttagtagcctagcgaagcttcgataaacgaagtttaactactgcaaagcatgcgagaggccctgggttcaattcccagctcgccccagattttttttaatttctgatcttttctaccactgattgcaacccagtggaaagtgtcaaatgagaatattttcgttcacaaaagcacgtgatcagctctgtggcttcttgtatatattaagctcttattaataactgtaactttcaacagtagagcaatgaatttattcttattacaaccttatcatctgttttatcttcactgaagtgtttcttacattattttacactggatgacatcggcatccgagtcactgaattatcgaatctctctgaatccgaaactgaagttgtgaggaaatagagttgataatgtcatcggcaatactattcgcttcaaaaaagtcgtttcctgcagctcacaatgctgtgcgaactaattggaccagatattcctcagcattgaacacgtctacaaatcctgcgatgcagtttccatgcctagataaactcgaaaagaaaactgcaaagcttagaggagatgactcagatcctaacacaccaagctccaagatgtcatgctctatggaagaggatgccacatccgcatcttcaaagaatgacccagtttacgggaaagtgagatcaggatttcagcttttcaaatctaaacaacctatatttctagactacggtggagtgctaccgaattttgagttggcatatgagacctggggcactttaaatgaagataaatctaatgctattttaatacatacaggacttagtgcatcgtcacatgcacattcctcatcgtcgaacgaaaaacctggctggtgggaagacttcatagggcctggaaattcaatcctagacactgataagtggttcattatctgtacaaatgtattaggagggtgctacggatctacaggcccttcgtctctagatcctggagacgggaaaccgtatgcaacgaggttcccaatgctctcaattcaggatatgatcagagctcagaagaggttaattgactgcttcggaattaccaaattgaaagcatcagttggaagttccatggggggaatgcaatctttggcttatggtcaactatttccagattcagtggaaaaaattgtttctgtctcagcatgcgcgaggtctcatccatcatctatagcaatgagacatgcacagagacaggtactaatggcagatcccaattggaaaagaggattttattatccaagtgaagagcatccggatagaatacctcctcatgtcggcatgaaattagcaagagaaatagcaactgtcacttatagatcaggcccagaatgggaatcaaggttcggaacagaaagattagatgatgacaggtctcctgttctatgtccagattttcttattgagacttacctggatcaccaaggggagaagttttccttagaatatgacgcaaactcattcttatacatttcaaagacgatggatttattcagcttatcaaagtccgaccaagagcgcagccagaaacgaagattgcaaagtcaaagagattttgaaagtggtgttttgccttcgtcaaggctgccggatgagccatacaagtataagaaaagacggagaacaacaacgatagaagaaagcagaaaagatctcgaagcggggatgactcaacttctagataaagatatcttggtgattggtgttaagacagactccctcttcccgtattggcaacaaagagagattgttgaacttttaaagggaccgaacgataatgtgacacatgttgaattagacgagaatgcgtcattgtacggacacgatactttccttctagatttagaaatagtcggatcgagcataggcaaattcctccgtgatcagctataaaccaaagattgtgcataaatttatatagacaactttttttaatttgatacgactgcattagcgttattccttactttgttttcataattatgaaatgtgaagtatgtatatatatacaagagtagcagattctgctacaaataataaacgaagatcattttgaagcgtatggaaatatatctatcgttttcgttttcggcattttcaattcctatagtattcttttaaaatctattgctcggaactgaacattttttccttacgagcagccttacgcttagcatcggcaaccttattcgaatccttaatcaaaataacatcaccgaagaatttataatcttgcatataacgtctatccatattgaattcagacatagctgcattatccgttagacccaacttttgaatggtccagaaatatctttcaggctgatctttcttcaaatatctcaagatactttgtctttgttgtaccaaaattctcaacgctctaatgttcttaaaatctttcttattctcctttacatgtttagccaagttatgaattctgacggtcatgacagcagcctgtacttcgctcgaacctgtatccccggggaatctttggaattcttctcttgccaatctgacagccatcttcaaggcatctgcgttactagcgttcttcatattgataatacgaagcacggcctcatgcttgttccttagatttttgatagactgttcctcaagcaaggaatctaaccctgtcaaactagcttgcttcttcttggtctcttcaacggataccaatagcttttccacttctccatgctcgtaccctggaatcaaaacgtttggttcttggagttctgccatcacacggtctataaatggtgtatttggacgtccaagcactggatccacatcgtccaatgagtttttgatcttattctgcttagcttcgttcagctgttttcttctttgagctttcaagaacttgactgatttagcacttccaatgacactcgaactggagaaaggtctcacaagtggcctcacaaatcctgtacgtaacataggcacaatagatgaactcattgcgatacgcacttgactcaatgatcacaccctcacacaacaaagttatagatatacgagctgaagaaatttccctcttctcatgatattcatatcagttgaattaaagtcaattctcaatgattttcatattatccaattttttttctttcagttttttttgtcaaatgcactgttctacgtttggtgaaaagactacaaaaaaaaaagaattggggtgcattaagggttcgaacggagaaaaatcgtttgaaacgaaaatatgcacatgagttttgtcacgtggttttatttctcacaagtgagagtttactctgttgacaagtgcaaaaacaagaaatgaaaagaacaagcgcaatcttctgtgaaaggatcggcttcagtaggatgttgctattgttatttaataccagtttcactgtagtgtcactgcagtttcacgactttcattgtcaaatattgaataaaactgatatgtaactccatacaccacatataattacgttttctttttccaggaatggcctgtacattcgaacagtgaaaattttccaaattagacctcatcgcatctcatctcatcaatatcgaaaacctttaacagactgatgtacaggcgataggttttgagtagtcaaaataatctgttctgttgttgattatttataacaggtagagttgaaacacttctgttttcttctgtgattgaaacaccctggaccaatagatatcttttttaactgttcttcgaaggttaagatacggattagagtaattgtactggtaaaagcagcgtaattttgacaagagatataattcacagatgagttttagaggtggtaatagaggttcccgtggtggattccgtggtaattcccgtggtggatttggtggtagagctgcaccacaaggtcctccagattcagttcttgaaatgggtgcttttttgcatccatgcgaaggagacattgtgtgtcgttccattaacactaagattccatacttcaacgctccaatctatttggaaaacaagacacaagttggtaaagttgatgaaattttaggtccattaaacgaagtgttcttcacagtgaaatgttccgatggtgtaaaggctgaaagtttcagcgaaggtgacaagttctacattgctcctgataagttactacctatagagagattcttgcctaagccaaaggttgctggcccaccaaaaccaaagagaaagagatctggtgccccaggtggtcgtggtggattcggtggtggccgtggtggtgcaagaggcggttctagaggtggattcggaggtggtcgtggtggctctcgtggtggattcggtggctctcgtggtggattcagcggtggtcgtggtggattcagcggtggctctcgtggtggttctagaggtggatccagaggtggattcggtggttctcgtggcggttcccgtggtgggttcggtggtggacgtagattctaagctatacacggaaattcatgcatattaatatcatattaaaactaaaaccaaattaagaacaacgaagttcaaaaataaagtcgcatagttctctcttttggttttatttcccgtcttttttagagcagttcgaaaaacttccactataaacaattgaattaacttcttttctatataacaatcttagatcaaatagatcagtatttcgcatgtataatattaaccaaatcagaaatcattccatcagaaacctattacttcataatataccacataatacactgtattgatagacctcgatgcgttctatgttttctactttatttctttatcttggaaggtcttaccccaggtaataatccacaagcttctaggacaacataccgtaaaacatctaatccgaaacgtttttgacagcgcttatttgtcattgagtttaagaaaatgaatctaggagatgtgggtaatcgcagaacattactttcttcaataatgctctctacttgcgccatgtctttgatggtatccatcttcgtgaatactatttcaaaaggaattccatcgttaacaagtaaatctatcatctgtgcatcgtattcgctaaatccattattggcacttattagcaagaaactgcgacgtaactctcttcttttatgcaaataatccatcgtgactttcccttgttccacagttcctttagtaccatatcctggagtatcaatgatgcgaaacttcccacctacattgaaacaattgatggtctttgtaaaacctgcctttttggaggcatttgcatattcgtttaaactatttcttgtcacctccgtagtgacactgtttaaaagagtagatttccctgaattacatcttcccaaaaacgctatttctggtagttggttgatcaactcgaatggaatcccgcccgtcttaccttgatacattttattagaattaatctgagggacatcctcagacgcaacaggtaacgtcatcgaacctttcttgaaagttgttgatgcaataaattcattttcttcatccattatagtttgtattgcttgctgccttttttccatcaagcgcctaaccttttcacctggtacatcattgaatgtaggagcactccattcgaacttaacctttgccttgttgaagaaaaaattgacttgtgataaatctgaagcttttagaggcgcatattccttattaagtttttgatataaatcatttataattgttttcaccttgtctgggtctcgcctctttgcgtgcctattctttctgatttcggtgttctgcctgtcatggttcactatttgttcctttgatgttaccttagtattcatcaccaaggatttaacatccaactgcgaaaaaagtctggtgcattgtttcatagttgtgtcgtcccacctacgtgatcaggcgttattgtatcttgaaagcatgtatggtgtccatatcattgttgttttattgatccagatttgatatactaactaactaaactgggtagaaaattttcttaagaaagagtgagatcaacagaagttaaagggtatctatctacaaaaaaaaatgaaataaaagaaagaaaggtatctaaagcagcccgaactttgtaacacaatattccacaatgtggctaattttcaagtatgtatatttagatagttttttcaattaaaagtttccagaaagtttactctaattattatcgaacaagccgccgagaacgtcaccttctaaattagggtcctcaagcatgttcgattccggtttatttttccctagtaattgctcaccagctctagctaggatagcttctcttctctctttagtttttgcttcatgatctgcggtgaagtgagagtcatcttggtcaccgtagatatctttcatccaatcgatgaaacccgcagccactactctctgatctttgtaattatctacttgctttaagtttgtgtaaagctcgtcaatgttgtatcctctggataactcgtataggaattgattgaagtaatcgtactccttcgaaagggttaagaaaataacggtaaaagcgtatagagcctcataaaacgaatccttgaaagctctttgagtcaatacattcatgatcaaatttggcacaacttcggtagtataaaatctatcaacatctgggtgttttgctaatgtttcggagagacagcttttcaaaatgaggatggaattgaatgaacatttgctgtctcgcactgagacgagcctattcaatagtcgcaaaaatggggcaagaatattgatgtcttcgaaaataatcttacgcatcttaatttgatgaaccgagactcgaatctttgaagcctgagtatgcgatcccacttgtccaattgaatctatcaataatcgaacaacaacagtggtgaactggcgtaacaagttctcttcaagaatttcttcggtcatttcttcttcatctctcggtggtggatttacttcactttgggtatgagttgaccatttcttttccaacattaaatctagtgttttgaatagttttggtaaaaatgctgacataaatttcggagcacattcatcagggcagtttctgagtatcggtctcacagctacgttgataatatgtttccaaccatgagttgaaacaccaggacttatgtctccgtccggcgtgtaaatggctattgagtccatcatcagattcgccaggttatctacctcaaagaaaattgatccaagtcccgacatagaagcaagaaccaaaaggacgtattctctagtgtacctaacaatgtgacccacagaatcagcaaaatcgcgcacagtttgtaaagccttattatgctcatcgataaattcgtctttggatttattcgtagcacctgcctcccagaatctttcaacagtagatacccgaacgaaggactgaacaacggttggcagtgaagcccagttggcagggttatgatacgattgaagctggaataggagtcttaagatatacggtaagataggcacaatacgtggcttccacaactcttgtaacatccggaactcaacatcgcccttgacgctctgcatggaataatggataaacattctagtagcacgaactggaaatatagtttgccaatgctgtgttaaatctgctttaagtttctttccgtcttcgtccatctgaatggacaataagtcactattttcgtcgatattacgtctctgaaaatactctgctattttcactattccaagtctttcaaggaaccatggaagatccgtcaaaccaacaactgtccccttatcagaccaagcagcaaactcaggatccactaactgggcaaatttttcccccttattctccaaattagatttaagaacaatagttaataagaatgacttgaaagagatcgtttcatgagagctcaactttggtagtatgcctgcaaccacattttcaagatcagggtatattggttgtagggatgctggcattaatagggccatccgattaagttcaataccgcaagcatacctcaaatcacgaactgcatctgattgttcgctcttctcgttcatatcaatctcagggtattcaagagtagcggtagtaataatcttttctaataacgtgaaaagcacgttgtccttcaaaatagttaagaataatgcaaagttttgaatttgtttcttcaagagtaatggctctctcaaatttaatgctaaaagttggttggataacatttccactttcgcaagaattgcgtcaagcttttgactgaaagttgattcgtctgtataccatatcttccatcgtatacaaccattaatgaaacattctacaatcataaattgagtcagagcactcaaatatggttccgacttgtgatccaaataagtagaactgagaacttgttgtccaaattgagatccaaagtatttattaagtctctcacataaccaatcatatgcaaagtctagttgaacacatgatatgaggcggataatatccctgattctctttctatagcttgaacagtagttctcgtattcagctgtcgactggaagtccacttcaacgaaattcttggagacatgatcttcaatctgttcgtagtaaatcaaagcatttccagcaaactccaacaagtcgggaataaccaatttctctaaaattggtaaaaattcatcgtttctcaagcatgcacaccagagatctaaggaaagcccgctgacaatcaaactgggattataagtagtttttaaaacaagcttcatatatgtttcgatgttttgtagatcagatattttgagcacgcatgtgtataaacaggttatcatatccacaaacttcttcataattggatatttggcctcatcgataccctcaattggatcgaaaagcaattgtgaatatacagtgtccattaaacccatactgtcaaatacacgattcacaatcatgttgtaatgatctgtgttactgtatggacgggtgaggagaatatggatagaatctagtgcaatagattgggctttgggtatgtcctttgttaagcaccctaacaatgcagagaatacgtcattggatacaataacttcgctcaaaggccagttcaagcagctctttaaagtttccaacaacctaacgatgtactgggcattttccacttctaatgctgcttttaattcactggtgaaaagagcaaaccaaccttctggattggatttgaacatctcccatttaccagagtacttgtatttcacactgaagacatccattgggcagacaatcattatgcagagcggttgaataatgggcaatctcttcaacacggcaacatcttcaagtaagaacgtgtcttcgaaaagcgttctaaagattatgagaactagctctctagacgcctcattcatctgccatagttctgttaggcatctatccatatcgacccacgattcggctagctgttcctcagtaggttcttccactttcaaagcctcaccccagatccttttcgctatttcgacccaaaggaaagctagcttctctctaatatatcttggatcattcggttgcaccctgtagtttagttcaatgatccactttcttaatgccatccgtttttcttcatcataacccgaccaatttttctttaaggcgtttaccaataaccctaatccaaaatgttttaatattgaattctgtgggttattgagagctatttcatatccccaaaacggcgattcttctctctctttcacttcgtccaaaaacttctgtgcatccaatctcttcgcattatctgattttggatcgtaaattacttccaaagctgcgaccacttgagaagcgcctgaattttccattgctctacttgtgcccagtcccttttcttgcttataaactaatataatttaagagaactcgtaattcttgaatcaaaagtgattcaaaatatcagaaaccgatgtggtaaattgagacagctatgatatcaagtgtgtttattctcccaattcgctttagttacaagacagaattggatcagatatttcctgttgttttcaaaatgagtccagaatcaacgttaagatgctgaaaacaaaagagaggtaatagcaacagtgtacaaaaaaaagagtaaagtggcttagtgtttttactgtcagtgtttactttcccagtgatcgatcgtgttaataattcctttccaataaaacaacaataacaaacagcctgaaaaaatactttttcttagattgcaatcgatcaaatataatgaccaagaatatgacaatcctaaagagcaattagtgtaccacctcttcagatcaacagagtaaccgtttgtttcaattaatcttttcaacagtgggcttgtactcatttaagcccaaaacattccaaatcctttaaaggtttcaatgccctgttttctttaaagccaaggaatttctcattttgccaccacttttcgtcagcctcgtgagtagtgatgataataccgtcaaatctttgataaatctccaagtgcaggactagtacacaggtggctttgaatttgtatataaatatatgcaaatatatcatagattgaacttcttcttttctttgtccattgaaggtttgtgttcccattctgtttcctctttgatacctctttgtagtcttttgagtttcatagtaaattggggcccaagttcttgaagacctactttctcttcgttcctgaaaacgtaacggtgtctgcggaagaagatgtaatctctttgattatgcagcgttatcacttgtctaccttcgaaatcagggttcttagggaaaatagattggaatagtttacccacagttttaccaagtctggtgttgaaattgttcaagattaactctggaatatggctagttggtctaccatggcccacgatcttttcgacttcgacgaaagaacttattttgaaataaaaggttggcccctctggaagatgaataaatgtaagccccgttactttcttcttatcttcatttattatcacgatatctgtatagttcctgttattacagaattcagagatttccttcagcttgtatccaaatttcctcttcacgaaagtcacattagggaaaacttcgatcaggatattagcgaactcatatgccttctttttggcgtttacattagttgttaatagaatctttggtggttcggtaccgttgaaaaatttcataaaatcatccatttcaccttcgacttcttgacccatcgtttcatcgtaaactctgaggttatcaattgtgtcaggaacattttcagcaagtcttttttccttcaattccggattctcacgttcttccttggctctggtcctcctcatagaatgacgctccttattgtgctgatccttcaactcagcaaagagtttttgcctcttctgcttgttttttattctgagttcatccactgccattttgaaattatagtatcgtccgatttgctgttatgcaccctcgctatttgacctagaataagctacataactagctatgttccactatattcaacttctatcttgttagcctcatctcatctcatctcatctcatctgatcaatacaaaaactttcaaaattttggaaagctaattttcgataaaaagaaaagagttcacattcgtcgctgcaatcattgtaggaagggtgagctgacgaatatcccatcaaaggatcttgattacctcaacgaccatccacaacagagatccatgctaaaattgaataattttcgtacttgcaatcgagttatattgggactttatatgcaatcgaagtttctttttttggtttccatagtaatatatggggaaaccagatatcaattcaggtctatatatacagaataaacaaaatattaaagcagaacgcaagcccacgataagaaatgaagtttaatagttaaaaaaaaacagaagtaaacgacgtaaaaattggccaaaaagcaaaaatccttaaacttgttcattggattgaggttcaaccttttccttttgaacattttcaattttcttgccatgatctgggtctctctcatcagccactctgttcttcttctttggaactctagccaaccagtataggaaaacacaaccgcaccagttgaacacaatgaagactatgaaaataccgaaatttctccatcttctatggtacgaagattggaaacttgtcaaaaatgcgtttgtttcagaaatcttacagaaattacaatcttccgtagcatttgaatctagtagataaccaccattcttgtcaatatagtccgccatgtactcaccacaggtttctccactccttggattaaagctgacgtattcatagtttgcgcatgttacagggttgtttgcaagaccagttgagagtacaccatcaataaagtaagttagcggtgaaatacggtacatgaaaatccagaaccctggcaaaacaccagaaccaccaaacacaccacagaaattcaaggacatagtgaacattaatgatgccatattacctgcagcctcagcatactgaagacctgcaatacacaattgacccattgaactgataaatacgtagaaggaaacagagaataaccagaataacacacctctttcgtttaattgaccggcatatgacgcattgttgtagaaaccaataggatagtagaaaacgaagaaggcaatggtaccaaaacatatgttaagtggaatttcaacggtgatttgagagaagataaatgccagccaagaaaatgttctacttggacgttccctagcttcgtacaagtctctttgagagacgaacaaaggcaagtattgttgacaagctggattaaagataactgtgaatgtgaagatagcgaataattgattctgcaaaccttgaatggataagttagccttgaaaaatgtgaaaccaataaacaactgcgagaagatggtcaagaaaagcttcgaccaaatgtacgatggagttctataatattgttcgaaaagacgtaatgtaacaaccttgtactgatagaatagagaagtaccaaattcgctttgttcagaagaagtatctaacggtttcttacgtagctcagattccatccaatctagttccttttgaacagcttgatattcatcagaatttctccacacttcatggtaatcctgagttgcatgagaacctggcgcagcaccaataacgtccaacatccattcagctgggttagcaccctcaggacattttgacgcaccatgtttttcaaagtagttaatcatttcttgacaaccttcacctaaattaccaaagtaaacagtcttaccacccttttgtaggaataaaagtatatcaaactcttgcatcaacaatgcggaaggttgatggattgtacacaaaatggcttgaccgtgatcagctaatttcctcattaattgacaaacggaccaagcagtttgagaatccaaaccagaagttggttcatccaagaataacaacaattttggtttggctgccaattctacaccgatagtcaatctctttctttgctcaacatttaaaccttcaccagcaacaccaacaacggcatctgcatactgttgcatttccaagatattaatcacgtcttcgacataattgttcttttcctcaattgatacgctcgaaggttgacgcaagtatgctgaaaatctcaaagattctctaacagtagaagttgacaagtgcaaatcttgttgttgacagtaaccgatggaccttgggaaagaattatcacgcaagtgcccattgacgaacatgtcacctgtaataacacccattgtcactcttgaagccaaacaatccaataaagtggttttaccagcacccgatgaacccatcaaggcagttagagtacccggcttgacccaaccatcaacattagataggatacgacgtgtttccttttttatttggacgtcataacaaacgttcctccaatggaagattgcttcagatttagagagaccaacattgacgcttttatcagaacttgaagaaatatttgattcaactaaggagtcttgtaacagtttttggtcggtgagagcaccttcagaatcttgaacagcctctacatcatgctttgccttaattaacttttgcttcttagcccttttcaaaacagattttgggaatagtaatatttcacctttttgaacagcactttcgttaaattcacagaatagtaaatagaacgccgtgaagaagatgaaataagcaagagcaatacccaatgcacgccatctgtgactagggttgtaaccataggcttcttcaatgaaagctctaccactaacataagaaagaccaggttgcgaagcgacggtattacagactctctcatataacccaatattttcataaccactgccagatgggatataagctgcacatgggaaatctctaccattaaattcgttgatcattagggattcaaagatataggatagaggattgatgtaccaaatccatcgagaccagcccaataaattcttctttgggatggagaatccaacatataatgagatggctaacaatagacatgatgctggtaccatcgcttctgacaacgtttttgtagcagaaccgacacacctgaagatagcggacatgactagggtagcaaggaaattcatcaaaaagtagaagaaaaatggaccagcttcccttctgaagttcaccatgaagtataaaatcaaattgaaacagatagcggttataattttggctggcaattcagaaagcatcgaagctaaggcatcagcagaaggatggtatagagaatatcttttgtgtttttcaataattggtctagcttcatacaatgagaagatttccaacatagaagagaaagaattgaaaagaaccgcaataaacatcgcagcaccacggtagaagaaagtgtttgttgttgtatctttcattgacttataaaagatcgaacctaacactaaggacatcgcagtgttaccaacgatagtacccacagtaataccataactttttttaattcgcaaaaagtttctcattgtcaaatatttcacttgcataccgtaattcacaatgtatggagattcctttctttgacgtttagattgtcttgcaatatgagcttcaataagctcttgacgagtttgagttgaatccttattcaattcttcttcaatctctccacgtagttgcttatattctggcgagtttctccaatattcttccatttgtttagctgtagatgggataaatctgccttctttgacgaattcttggttaacaattctttcggctggatttgtcacagcggtcaagaagtcagcggttgtttgccttgaaggagagacatatcccattctttcgaagtatgccttagcagcctttgcgttaccgtaaaaaatttggtaaccttcatgtaacacgcagactttgtcaaataaatcataagcatcctgtgaacattggtaaattgcgataacaccagtcgaacctgagatatctgtacttgttttcaatgcacgaataaactctaaagcagtggcagaatccaaaccacgagtagcattgtcccaacattggaacctggaaccacaaatggtaacttcagcgatcgaaacacgcttgcgttcaccacctgatacacctctgaccaattcgttaccaacttttgtatcccttgtgtgtgatagaccgtaagtagccattgcaacctgtgtcacgtgattggcaaattcttccctagtggcacctttgatacggttagaaggagtaactaagagcgcaatattgtacaaagtttcatatactgacaaatgagggaaatgcacatcactttctgcgttgtaaaccacttcaccacgaaaatgctttttgatagttcttggatccaacccattataagagataacggaattctcatcgacgttataaccatcaatgttagacgagatagttttcaacaaggttgtacaaccagaacctggacgacctagaacaactaacaaatcacctggttttaacaacccatccataggtttcaatatatcgaaaacgtcttctggtttacttttcacgaaatgtctctttacgctggaaaatatcttacctggcaagttcaacactgtgctttggtaagcaacgtctgtagagtcaccgaaagctctcaagtccttccaacaacaccctatcgtgtaatgcttgtaatattctggatcattattagccaaggcgaccatattcttgatccacgcagcagacgaaaattcatctgaatttgggtccaatctgacatcatatcctgaagcatctgaatcagtgaaaacaggattcacaccctcgtacctagtactgaaaatcgatttcgcaccatcatcatcagaagcaagtacgtttccagtcgattcttgttgagatgcttgttctttcagactgttgcgtgagagagttcgagccaaatctctgatttgctcctgaacctgatgatcaaacccctggtactcgaccagactggaggttgaatcagcatccatgattctcactatcgattattcctagttttttttttacctgtactctttatctgtctctatttcactttcctatttcaatgttctaagtaataaaaatgaatattaacaacaaacaatagtaatagaaaaaggcaaaaaaacaacgattcaaatatcaaacaaaatattacctggaaataacgatcttgttgttgtatgttatctgaaacagatataaacaaaaatctaagatatactaattcaccttcaaaaacaaacttgagatgagttccaaaaagtatacaccatgcaggtcggtatgtatatatatgaattacaattgaattcataaactataaataaaaactgtaaaatacgataaactaactataaactatatttacaatcatgcgaatgggctgcatattgattaagctactgccactccttatcaaaccgttaacaataccggaaggaaacatggtacgttccatggaaacagagcagatacttacccagttaaaacgacaaagaaactcgcattttttcctttatttccttcaaactattagattattaatacatattacagttgaatagatacttttttatgggggaggggcatctcattgtctatggactctcgtttctcaaggacacatacacactggaaacactggcgattggtctttttttgatgtctcagttctgcccgatttctgggggtaaagttttcataaaattgacatgtcgtagaaacacccgcaaaaatgaaactattgtcgttcagggaccaattgttatttgcacggattaatgaaaaaaaatttggttccgtggaacactttgtatgtgttatgcccatgagggtgctttttttttttttggtcgattggtgattcattcacggaacaggctgccccagccaaaacaattccacggaacagtattccgacatgtggtgaaaatgtcttttcgttacccggagaacagcaaacaggctgagacagagttttaatctccaacaaaagactgcagcgtaaatacgaacgggatctttgcttactgataggatagactccgtacagttatgatcaccattgtttatgccaaggggcatagcgtaattgtattgcctgtgatgctttatcaacggctgctttgtgtcttgtgcctttttttcgtggactcgaagactggaaatcttaaatcacgtgatagatgaaggaccagggaaataaactgtcgcgcgtcaccggacacaattaactcgaatggaaatatacattcgccagagcacagtattataccatgttcgatgcatctttgtacaatatttttaccaatatttcataacaagactattgtaatgtcttgctactagtagcaacatataacagacaaaggggaccttccctaattacaaaccaaattatctctctcattttttttgctggttctctcatcaaatccattgcttcgctatccatatagtcacctacgttggcctttcccatcgctgtttgacttgtttattctctctttttctttacatgtcttcattgcagtataacttagcaagtcctatcgagtttctaacacggtttttcgatcgaaagatcaacgattctgttgatattgtcgaagaaaccccggaagatgttcagaggagatacttgtttatggaatttatcagctcggagaccgagtatttagagatgttgaaactttttgaacacacgtatttggcaacactcaacaaatctgatcatatcgcatggcaaatgactttccgagtggtccaaaatctagttaagggacacgagaaattgctagaacaggttttcggttggctagagttgcccatttcaactgatgataataaagcagaaatcaattgggaactccatgcttcccatataggcaacaagttccagtctttgaattctttgtccaattttatccaagtatatgtcgaaaaattgcttctgttagaaccccattacaaggattacgtgtatcattattctctttgtaacacgttcaagaaacatggcatattcaacgcgaaattaattaaacaattgtaccaaatggaaccaatgttgaagaaatttcaacagcagcggctcaattctcaatgcactgatttgtttagaaggaatatttcattcgaatcactaagacacttaccaatcgcaaggttgggtcattataaggttttctttgactcgtttttgaagtccattgagtcgttaatcttgcaaacagacacaactatcggagaagataatgctatggatctcatgggaaaaggacagaaaggggaaacaaaatgtggttctgccgcattgaaaattctgtcagctttgaaagaggagtatgcagtaccaaagaattgggagttattaaaaatgtgcgtcatatcggtacaacacatgctcttaagagttgatggggtgaacttctccaacttgatagataaaccttcgcaacggatctccagtaagctcaaattcaagaaccccgacgaatacgtcccggtatcagcacttggtgttccgcaattaactggaattctaaacactgtgtggattgaagtaagtgaaggtcaaaaactatggaataatactgtcagatccattgatacttggagaaggaaaagagcattgtatccaattttccaactaaagggtaagcaacttggtgcttttctatataaatcgtatttggttttagcaaggattccaatgattccaatgactgaacttcaaactaatagtgcggctgacgttcattggactattaagtttgccataccgttaacgaattgtaagttgatcccgatcgataaagaacagaataagtacaatgaaattggattacatgaggatacagcttcaaaaatagaactgtttaaattggaatggttcctatacggtgatatattcgagaccatctttatatttgataattcatatgagtgcaagcagtggtctgatgcattgcaaacgataattgatttgaatggctttacttcaaaaccaatggaagctgactccgtagaaaattattaccagatgggtaactcaacctacgctccaattagaattgctccaaagttaacatttgcagatgcagtttcaaagactcttaatttaaatataacgagaagacagtacagcttaatcaaccatccagtacaacattattactattatacaagtttcaaattgaatatacggtttgatgcattaaaatcgggcccaactaatcaaaaaactggtattgccttctccagggataagtattctttcctcgagagacaagtctttgcattacagcacccgttcgattcattgcagtctccaagtaaggccatttcactttcagataactctgattccaaggccgaatcgtcgactaacactgatccttctctcgctctgaccatacaaacaacacagtcctatccctcatcctttaaatcatcgagatcttttgttttattgaagtccaaatgttcggatattaaatctttctttaaaggaagcaattgttgaaagcggttcaacaaaaaggaacaacgaactgcttatagatagatcatccttttataacataaacctagaataaagaaatatgcataaattcaatagactgttaagttcaaatttggaacctcaaaggtaaaaactggtcatttctgaaagaaattgatggtgtttattattatacgtgactatggacgatagagagaaatgacattgaaatatctctcgatatatgttaatatatattcgttaaactcatgaaatttcttggaaaaatccttcaaaggatgggaggataaacatgcagatcaattagtgggcgtaggatccatgattagcatcgttggtagaggtccaccttttcctgttgatgtttgtatttccgaatggcttaccatttttcaaaataacgtctaacaactcttccactgatttctttgggccgaattcgttttcaagttgtgacttggaggcttctccgagttcaccttcagaaccacgagcatcttgattagcaaagattttgaataatgaaactgtatctgttaacaggcctggacttgggtttttcacataatcctgtaccttttcttcagaggttacaaaaataacgaagtcggtttcttcacctttgtaaaagaatttgactggttcagacatgttgtttaaaatgagttgaagtttgtttcggtgtactgtatattcaaaataggctgcaatgtgttggggttaaactgattgcttgcttgtttgatggagtttataagtctattgtctcaaatctataatacaaagtaagaagctatacataggatccttgaatatgctcaagggaagctatttatatacgttttaggaaaatgaaccgtttaggaattaaagcttcgaacttgttctatcgtacgtttgacccaacacattttgctatagaaatgctttctgaccctttattcgttacgtaatggttaacgaaatccaaacatatgagctatggtaaaaaaaaagcaaaacttgtcagtaatgacaagacgtgatgtccaccaacgaggcgccgcaaacgtacattcaattggaaggattagcaagccttggacaccgaggaaaccaaggaaaacaaggaagtcactggaagcaattcaagaagttgaacattaaagaagcgggatcgcttcgaccaggtttccaccggcaacggatcaacttttttttttttttttttttttttagttcttcggtagtctgaggatgctgcctgcctgtctgctggcagaacttaccgcaaaggaacattatggacaaaagagcaccaggcggctagcagcccttcagtagatacgtaatttaccggcataagaacagagtggtccatagggtgaccactacaaggcctgcaaggtggtaaaaagtctattatattgtggtattttctatatatggatgagtctgaaaaaaaagtgatttgatgctaaaagttcttatgaatacactgagctaaacagagtgaatagatcatgaaatgtgttggtgcaatatagtacacaatcagtagtagaatccattggcaatgaatctgaccatgtattcttctacatggctggttccaccgtattcatcctcggaatcttcgttgttttcgttgtcgctatttccatcctgtgcggcaacacttccctcttggaaatcttcattatcgacattgacctccctcaatgcagattttgcggcctttgcgtcatcttcatcctctgcttgcgcgagtaacttgtttaggtttttctgatcttgaagtagtggtttatcgtcaggtatatcctctggggcttctgcaccaagtaagtccttcacagatagcttagtgaagtagtctgtggtgaaatcacctgtttggatgacaacgttgtccaagtgcctcttttggtttgccttcttcaaaatattactttcgatggtgtggtcgcttacgaatctgtaaatatggacatctcttgtttgaccaattctgtgacaacgatcttggcactgtttatccattgctggattccagtctgaatcatagaaaatgacggtatcagcacctgttagattaataccaagacctcctgatctacttgaaagaatgaaaacagtaattctgggatcgctgttaaacctttcagttaagatttgacgatcttcaattttggtagcaccatctaatcgcatgtatagataaccatgaaaattcaaaaattgttccaagatatctaggacttttgtcatttgagtaaatatcaaagccctgtgaccattgtcctttaagttttgtagtaattgtgccaatttctgtagtttaccacaatcgtattgtaaaagagatttatcagggaaagcaaccgataactttgtttgtaattggtggaatgggttttctagcgatctcatctgggagactaaatgatgcttcacagactcttcaaaccgcttgttattatcatccactcctactgccctctctctgatgtctaaggttacaactggaggagtgatcactgcaaacttttcgatggtttctttaccctccaacaatcttgtttctaatggttttatggattcctgtgtgagttcacaatcaatgaatttctttggaccaactgttagtagcttcacgatattagatccgtacattggtcttctgttacatctcaaattgttcatgtagttgagatgttccaattgacctattatctcattgatcttgttatgctttgcgtaggaataatattgatttagatcttgaaagtcaggctgtgttacaggtgaatcgttttcattgagttgtttcaatctacttatctctttcaaaatcggctgtacacattgaagttcactgatcttctcagagtggttggtgctcaaagttttatcattcgaagtgaactgaaagttcaagttggataagtctaccgaagtttcaaactgattttcatgtagacggttgtaaacgtagttattaaggtcgcaatacgactttgaaaccgaatcctcaatgcaaaatgaagtcaaaataggtctaacttcgaataaatctggatgattgcaaacttttcttagttgcatcaaacagttgataatggacataaagttaccactggcaagagtttccttggtctgagctcttgacataaaatcatcatataaaaatcgttgccttttagatagccgacagtagattatatgctcatattttcctggcatttgtttttcgacatccgctttcaacctacgaagtaagtatggccgtaaaacctggtgtaatttcgacactgtctttttagtctcttcatcttgttcgtagttttctcctgtttcgacaattttgtcaactggtctaccaaaccattgctgaaatgcatctaagtcagcaaaaccagaaactttaccattttcaagtgctgtttgtggcattaggaaatatagtagggaccaaagttcagctagattattttgtagtggagtaccagtaagtagaagcctcctttcagtattgaaattcaaaagggcttgccaacgagttgatctgaaatttttaatattatgggcttcgtcaaggatcatatattgccattttttacgcttgaatgaatgttgatcatgaactaccaactgataagaagtaatgcaaacatgaaacgcatcaggtttgttccatcctttacgcttttcccgtctctgctggggggaaccgtagtatgtcaaaactttaaagccaggagcaaacctcttgaattccatttcccagttcaaaagaacggaagttggcacaacaattaaatgaggaccccaattttctttctcacaggcgaggtacgctaaaagtgaaatagtttgaatagttttccctaaacccatctcatcagctaaaataccattggtcttattattgtacagcgatgctaaccaatttaaaccttgcttttgatatattcttagtgttccacgcaataaggaaggtactggaacgtccgatacagctaaagggtctgcagcagcgggtgaagtaacactttctgtagtttcagctttttcatcttttaattcattgtcagactttggtggagatggcaattcttccgtttttgaattattctcggcgcctgaactatcgccatcaagtccgtcatcagagctactatctgcatcaaagtttacatcagcctccacatcttcttcgttctcatcaatattaccaagaagagcagataatcctggggtatcctcttgcgcagaagcatcagcatcctccgtttcactttcggacgagctcaacgaatcttccatagaatctgaaacagaatcagatgcttcatcaaaaattgattcgtctgcagcactcttactagtttcattgccaaaatcattgattttattcaattgtgcgtatttggaccgtaattcttctacagaaagttccatatcatttccaatcctttccgtattaccttctttatcagagtcgcaggacgatgtactcatcatttcatcatctatatcagaattgccatcagattcttcattggcggaaaattcagagcttgcatcagatgcttctgaaggatatgtacaagaatccaattggtttaactgagcaccgagaagctgtgtactctgctccaacatctctgtcaaatgttgctttccttgaatcctttctagttgatcaagttcatcctttttcaagactttgtatgctttttcagccattgtccatcttttcttgacggcttgcattgcaaaccgggctagattttttttgcgcttttcttcttctttcagtttacgttcttctgcaccagcgatgtgtttgaaatgagattcgattatctgtgccactctacgtgccttagcgatctgtgaacgtcttgaatcttggaaagatttacttaatacaattccttggttaacaagatgatcttggaaagtatgcttactttgttctttataatatacggatatgggttcagcggcgtttgatggaggcataacatctctgagagacaaagattgcaacgaatctgtttgtggatcatatttaatcgctcccctttcgaaccctatccgtatgagtttggcagtcttccgttgttcctttatgtatgaatcgtattcctccagactaacatcttcatcaagagatttatatgattgcaaaaaggaatgcacgtcagcgtactctggtttaagaacatgcagaggattggtaatggtttggcgaggtgcatttacatgtaatttaactttcaatctatttggtaggcttttcttctggagtgcagtacgtggtttttcattatcgtcatcttctgacgaactagtaaagtaatactcttcatcatcaataatgtccccagtagtgttaagagaagttttaagtccactttcattattgtttataatatttttgcttttgttattggtttttctattatcattgccatcgtcattagtgtgcgtagggtctgctttcgtccttttagattcatttttaatctctggtgactgttttctcacaagttccgtttgtgatttcacagctcttttttttgatttagccttcgatgactttaatctagccttcgatttaccttgtcctgtattggttatatctttgacaggtgggtcttccgattcaacagatatatcattagtactcgagtctcttttattcagttttgatttcttgtctgcagtctgtttcaatgattttttgggagaagataccacaggagtgtttaacttattctgtgcagagccctgagcagtaaccaccgtttgtcttttcttgttgggtctcggtaccgctacatcctcctcactttccgccgggactgatgccacttgttgtgttctcttcctgcctctacggccacatacagacgcccttaacttttcctgcaactcactgtactcttgatctaccaacggcatgacctggccccatatgttattcttatctgatgacgagtctgctgttccagaaatgacatttcttcttttcaatcgtcttgatgcattactctctttcatatcatcttgctctaggctggactcaacatcaagacccctttcctgtaaaaaagttttaaaactgttactcgtgttgcggaacaacggatcgtattctaccaacgacgtaaactcccatagatgaaacaattcattcgtcaatagttcgtattccaatcgcgtcttcgctaactgacgccaatccctaacttctggcatcttgaaacaaacaaccgcagtaaatttgtatactgctggaaactagaaagttaacgctatccagtgatgtagtttccaggtacttcgcgcctcctaattgtgcgaaatatccgtgaatcgtggtgaagtgtgctattactgctgttattttccttaaggcgtggcaaaagtgttttttcccgtaaattcatttttttcattcttagatgaatataattgacagaaaagtgctaaggatccaatggaaaagccttcaagattaggttccgggtaacagtattcaatgttccatacttaaccgtaaactgcactgttgtaccggaacgagattacagacacccaattgccagccatctaggtcaactgcagcggtgcattgacttacactttctccatattcatgatgatatctatatttatatatctatatttatacgctcgtaggcaccacgctactgatcatgtgattacaaaaaggccaaatgcaacaaataagtaagctcagcttgctctaaattgtggttgaaaactattaccaaccactatacataggctagtagtgccttcagccaatctcccaaacaaattacaaaccaagtttcgagggcgatgtgtgcatgtgtgcatgtgtgtgttcttgtatgtgtatgtgtatgtgtatgtgtctgtgtatgtgtatgcgtgtgcgtatgtgttttgtcttttacatgtatggaatgagtttctttttgtctcagcatcagaacatggaaaagaataatcgaatagaaaaaatattactggaaaaagtcaaaatttcattaaaaggtaagggaatgggagttctacttgaaaggatgttgttcgatatcaataaaacgatttcgttactcttcttctctggtcaagttactcatcattacatgaacttgaaccactgcggacagatctttaagaaagggacttcggtaggtgatctaatttttttttttgaagaaactcttccaactttaggaaccaccttaatttgaactctggtttatcatagtgaagtaaactactttggacttactaataatcgctaaaatctcataacttaattggctctcatccgaatagagaccagtacaaccttgagaagagttttccccctttttctctagttttttaatacccaaaatcaaatgtctaagcaattcaagcatacaacccaggagagaagatcttccataatttactcgaacaataatggtaaaggcggtcttttctctcctcaagattatatttcgggagacaagactcaagcatttatagacgacgatattagcgaagattcagaggattctcttttcgcaaccaataattctcgtactttacaacacgaatatggttctacaggccgaacgggaagcagtgatagtagtgagattcattccgccttaccgaaaaatctaatacgagaagaacgggatctattgatggacaataagctgtacaattctaatcatgctcttcataatcatgctgcatattcaacaaatgatccaaactcttcctttgcaccaacatcatcaatcgaggatcaagaagtgattgaaacttgggaggatgcaattgaatcagggaaagacataaataccacatttaagagagaggccatagtgataacatctaatgcatcacctcttgtactgactttcattttacaaaactctttatctttagcatcaattttttccgtttcacatttgggaagcaatgaattaggagctgttaccctaggatctatgacagcgagtatcactgggtttgctgccatccaagggctctgtacttgtttagacacactttgtgcccaagcttacggtggtaaccactatcacttagttggtgtgttgtttcaaagatgtgcaattatcacgatcattctttctctacctgttctcttcacatggtggcaatggtctgaacagatacttgcattattcattccagaaagagaactatgtgccttagctgcaaaatatcttcaaattgtttctctggggattccagcctttatcctatttgaatgtggtaaaagattcttacagtgtcaaggaatcttccacgcttccagtattgtccttctcgtttgtgctccccttaatgcattgatgaactatgttttagtgtgggataaaaatattggaataggatatcttggtgcacctattagtgtagtattgaattattggttaatggctcttgggttgtttgcttacactttatacacgaaaaatgaaaaaaatcccatgaaatgttggaatggatttatcaaaccgcatcaaattttgaagaattcacgaaagatgttcaacttagcactgcctggtattatcatggttgaagctgagtttttgggttttgaaattttgactattttcgcatctcatttaggtacccatgaattagccgctcaatcaattatttcgactatcgcttctcttgcctatcaagtccccttttcaatttcaatttcgacatcgactagagttgcaaacttcattggtgcgtccttgtatcgaagctgcgtaattacttgcaaagtgtcattattactatcgtttattattagttcgttgaatatggcaatgatttacaaagctagatacctaatagcaaggcttttttcctcagaacccgatgttgtcagattggtttctagttcgttaccaatcttggccttcatgcaaatttttgatgcatttaatgcttcaactgcaggttgtttgagaggccaaggccaacaaaagataggaggatacatcaacgtttttgcattttactgcataggtatcccagtatcatatttgctaacatttcattacggatttggtgttagtggattatggtggggtatcacttctggtttagttttcatgagcattttccaaagctatgctgtatttcattgtaattggaatgatattatccgtgcagcaaagtctagaaatagcgaaggtgccatggtataacgtctctgaaaagaccacatatcgactaaataccatcgtacattaataaattaggaagaaggtaaaccccattcaatgcatcttatattgaacttttcatatatcattatctgtttatttttttgttgtttagatataaaagatttaacagtacatcttctagttgaaggattgagttgtcagctgtttgctaatcattttattgtacaataccatactgttccaaaattttggctaaattattatataaccatggtatggttttatcattttcctcaacaataccttggaagtgttcgatggattgctcaacggttatatttttgccctttgcatatttgttgatagcattcaccaatgcgctgcggcgctgataagttctcaacttgggtaatttagacaattgacctgcaccatgtttctcctcgaaatgcaagatctgaagctttgtatctgtataaaactcgtggtaaaggtcatggacgcttttgggacaatctgtcattataaggtgatagttctcaacattgttcagatcttttgcgccgagaggtctgattttgctcgagtgttgtgatttcgctaccttgtaccttgatggcatttctcgcgatgcgttctccgcttctctgctgagactactgaaaagaatttcatttttaaattcttctttgaaaacttttggcccttccgaaatgtcagcttcagtctcatcaattccaagtagaggtagaggatcttcattctctttatttacgtcaaaatccacttcttgttcctcggttaaaaactggttattcatatccaaatcatgagctaaaagatgtgttttaatgattcctaaatcaacaataatcccagtatgctgttgttgtattaaatctaacttagattttaacagggcaatttgaccattgacactttgacacttgctattacacactgcgtcgcataaaacgttccaatcagtttgtaaagtgtctactctgctttggaatgtatgaattattcgttcaatattctgtggcatctcatttgattctcggcgtcttcgcaatgcaatcaaaacttgaaaatactaattgattcagatgtaaataatagtgtatatactaaactacgaataagcacgaataacagaggtgatgatgtgaaagtttgtgaaatctgtggtttatataatatttgacatatgtttaatatagtaattaaatctttttgtgacacttttatttttcgtttttccttttccttcactgactgcatggacgcaccagtccacacagaaaaaccagcaaacctaaatgtggcacatcagaaaagttgttcgagcggcgatgggtttgcaccatccaaacaatactaggaataacgttttcctgctggttcgaaaacgcactgaatttaactactgttattcttttatgaattgcaaagtatcgatgctatctggaaaatttgagtacagattaaatacattttgtagggaaaactatcattgtaggagcggtgacagccgttaaatctatgctaaatgggtaagttttaagacgatatttgtgaaggatagaaattaagaaagaggaatgaaaaaaaacgcgatactcctgtacctctaattttttacgtttttattctttgtcttttgtcttttagcgctggatttttgttctttcgtttgctctttcttttgttcttcttgctcttcttctgcctcgacctcttccaagtttcttttggcttgcttaatttgcgtagcaaacaaggagtctagttcgtctggatttgcaatttctaacaaagatttctcaaattgtgatagttgcaattcgacaccatcaatttctatgacattttgaacggaagtcttagcatcatgtctggacccaaccaatttgtctaatacttccaaattaacgtataatggaaggactggtgattcgttagatttgagaagaatggttctgatattgtacttttcgatgaactgtttagcgacagaaatgatattttcagtcaattgttctggggtgaaccattccaatgaacctagatgaacattcatcgtgttacctcttggaagtttgactgggattttagtatcataaattctcttgatgctatttaccaaagttgtcttgttaaacttgttatccgatcttgtgttaatggcaattggagtggtattcaacttactgtatgctttaccacctaatagcttgggcaaagctgtcactatcgagtcatcagctagaatgaaagaaaaatcctgtacaaatgcacgcctcttttcaaaagccttgtattttgtcttcaaatctttaccagatatgatggcatcaatagtaatatgttctggaagtagatcgatcaagtcttctgatgtcactgaattgatatcagaatcttttagaatcaaaagagtcttgaaatctttaaccatggtggtgctagcttccttccatggcttgaagatagaatgaggaactgtaattagttttggtttgaagtttttcaaagaaccagtaaaagattcagtgttgactaggatcaactgtagctgagcctccaattcagaatcatcaattaactgattgtcatttgatccattttccttcaaatattcttgcaatttaataacagcattgttaactctgttaactggaatgacttcttcctctttactgcccttagtagccttggtggctttggtcgaaaccttgcttttcttagttttagttgccatattatctaaactttgatattgcttataatgtgcttgtagatatactagactggatgagtggagttatttcctctatattctggattctttccaagcgttttttaacttacttgattcgcactgtctcagaaaaagatcaacaaattgttggttcacctaggtaagcttacttctcgagttcgtactggcaactatgaaatatccagtatatatctaatcaatcctttgagctgagaaataagaataggtacttaaatactttacataccattactttattaatcgtgttaggtgtgcaacatacttcgagatgagatgagatgagctatgatgagatgagctctctattgtcaaaaataaaaattttctgtttcgcaggagctccactgtgttcacgtagttagtaaatattgctttttgaaagcgaaggccgtaatatatgatttgaaacttttcttgaaatttgataacatttgacacttaagaaataaagagtaaccgaatctgatattgaatctcggtgcgtgtttgtgcaaaagttactaatgagcaacgggctacgttcagtgaatggggttacaatacaaaagggcttaaactgtgtattttagggtttctttctctggtttatttcggaacagtactatttttgagttaggttttttcggctgtcaaacaggactcacgatcgatataaaggataccttaacagagaatacgccgcacgaatctgatttatgagttattaagttgctattattattattattattattatatcgtaaacatagtcatcgtccccgttcatttatactgcaaaaggcatattagcatatattaatcaaatctagccgcaggggtaagcatacgctctcacaagacaaataagaagagcattagacatgggtaagagaaagaagtcatccagaggtccagccaagaagatagtacagaggttagatacggcattcaattgtctcttctgtaatcacgaacgctctgtgagcgtaacaatggacaaaaagaataacattggctcgcttcattgtaagatttgtggacaatcgttccaaacccgcattaatggtctatcacaaccggtagatgtatatagtgactggtttgatgcggttgaggaagttaacgaagggaaacatagcgaatctgaagatgaaaacagtgacagtgactacgagagtgactctgatactgagccttcttcaaaccgtagaaaagctgttggaatagattctgacgaagaagaagaagaagaacaagaagaagacgaagatgcggattacggaagaaaaggagcgaccgaacgaaaagactcagaaccagaatcagactcagacgatgacggtaaaatatctaacaaaagaggaagagcagcatggatggacagtgatgacgagtagtcgaaccgacagaaacacagacatcgaacaccaatattaatcttacaattgtatctatctatctatatattacccagagatatactagtagaacgaataaaatcaggtataaaggagctgatatttacgttcaaagagattgctggatcttatctgtttcctataagaatttatataacgctcaccttggctttaaccatcggttgatagtattcagtttgtactgcagaagaatttatatatcaattctacatcaataatagtatctttggtatatcgaacttctcagtaatgtggcattatttctgaactagatggtgatacacgagataacaaaactcgaaaacttcagttgtatgaattcaaacaagataaaattacttctgctcgtaacggtgcaataacctaacatacgatcaagtgaaaacaaaagagcacatttttctgtctaccgctaaatagactaaacgcgtatgttaatagctgtttgtttgatatataactacttttccttataatttagtcagtataacatatatataattataataattgtgatgatgatgataataataataataataataatcttgattttatttgaattgtttgtaaatgtttcttgaaggtttgtattcacggttctgtatatgtcctggcaaataaataatgtcttcgtatctgctactaccagtagtcagcaccaaaaaaacctcctcaaacaaacaaatgtgtgacaagaatatatggtgtcataggatgggacacgttcgtaaatatagtttttgatgatatttattttggtttcatttggttgttggtgttgtggataagtattgttctttccttcctagtgaaaggttctcaaaaagtgaaaatagtatgggagaagatgataaagccggtgactttagattaaatgttcttctatatgcacttattggaacaattcctccttcaaaggaattcccaattcttctctaacatccttcaattcatccaagtaagccttgtattgatcttcgttttcaactttgtatctcaaggcttcgaacactctgacagcagttggcaagtcgttaacctttctggcggctctcaaggccttttcgataacagctggggctggaaccaaatcgtaagagaaacagttattcaacactctttggacttcgaataaatcgtaagcctcttcgaattccttttcgtatctggcggtgaattcttcaaaggtttcttcttcgtgtgcatcggagtactttctgatagaaacaaattgagattgtaattgaccaactcttggggcaacagcagctctcatcataaccggagcaacggctcttactggcatagcagctctcaacaaagttctggacaacatatttttctttgtattggttgattcgggatttggatttgattcactgtattaagatgatcaaatagctattctaaaaggaattataacaaaccgtattcacaaaagattcaaagtcgagttctattgtaattaaaacttaatgtaaaacgctttaaagatatatcaaataggttaggtaaaaggtaaatcgaccgataattttctctggagtttttttaaaaatttgaagtaatgaagaatgaaaaaaaaaaaattaaatacttaaaatcgcataggacaaatatcaacaaacagttcaaatacttaaactagtggatagctacgtctttgaactagataaaaacgagattgttaaaaggaaagtaagagtaataacttgcgaaacgaatagcacaaatttgaacctcgagtgagtcgttccattcgaaacaacttttattgtatcttattctttgtatgcatcatcttcttagtagtttacaaaaaagtggtattatcagttttttaaatagtgtgtctatggaaaatggatggaagaaaaaaagagggctaacataattcatcggcagagttgcaacaaaagttcacactccaaaaaatcctacatgtggtacttacgagcaagtcgtttatctagttcgattttaattatttgaattgagtatttcttgactttctgctgcctgtcatttttcagtcgagcgatgtcagattaaagatctcatgttcaaaggaaatgaaaccttaactctcataatcttcgaaataatgtcctataaaacaagataataagtccgtgataataaaccccacaagcagtatctatagaatccaataaaacacattcgtgaaatatgctggggggtaatgggcattgattgagactggtccgaccgttctgtagggtgtcttgtttgtggggaaggagaacgtattggcatatgattggttcgtcaccgatgatttttaccacatagtcgggtaataggacagcgggagaacgtgacttcaatacaaatacaattacccggaagtcgcgtggtttcaaaggttttttttttctcggtaggcaggttcccctgttcgatccctcatctccgcagaaaactgcgggttattatgtctctaaacgcgatagttaatcctctatatcgtcaaacgttgagataggtggcatcgcggtcttgatatgttgcatcaaagccgtatggtttggttcagagtttgtagacccctcaactattattcgggtatgtccattgtcaaacacttttcgaacagcaggttttgaatcatcgtcgatacctgcaccagcctcttcatgtcccgtgttacgattaggccattcttcaagcctagagtaatcaaatcccggaggaggtgacgctggcggagacactagaaataatgtctgggcagggggaactttaaggtgattcatcacagtgtcagcgccagcgtgtggaaatccagcttgtgaattcgattcagccacgtgattcgtgatggagaacccaaatttacaatcagggaataatgggttcaaggatttcacttcacggctcgcctcaatattaggcgatgttaccaatattctcttgaatccaggaagtgtaatgacacgcacggcatccgcaccgtaaatctgtcgagtatccaccacacattcttgcaccttatttacgatctcatcaaacaagggcttggagcacacgtcctttgtctttgacgttattattacagtatcagtagcaaaatcatcatacgttgccattccaaagaagtgtattcagtgtgagtgtaaccaaagttcgccgctatttgtgcatgtctaagtaaacacttagtatatgtaagtagtagattacgtagttactgaagaaagtgaatcgatctttacagtgaaatattgaaaaaaatattgaaacagaaaatcactaatgcatgagatgaggtgtgttcagaataacattacgtgtaattaagttacgcttgattcagtttgagatttatacgttagaattaattaaagagacagaagaatatacagaatgcctctcactaacgttatatactgtggtgtgtgtgactttcctgctgaatactgtgaattttccggtaaattcaaacgttgtaaagcttggttacaagaaaaccacccagaattgtacaccaaatggtatggcgatgtcactgaagatgtgtctaaacaattggcagaatcatctattggtgatgaaagagaggagaagcttgaaaaggccctagagaaactagaaagaaaacaacaggctagagaggaaagagaattggctaagaaattatcgtctaaagttgtgatcagaagagaagcaagaacaaaacggaagtgtatgattgctatctctggactagaagttttcgaaattgacatgaagaaactttccaaaacttttgcatccaaatttgctacaggttgttctatctccaaaaatgccgagaagaaagaagaagtgattgttcaaggtgatttggcagatgaagtagaagcatatatacattctttactagaggaaaaaggtatgaaagaagttaaggtagaagtaatcgatgccgcgaagaagaagaaaaaagctgaaactacaactacaccaggatccgaaaataagaaatgattatgagaagcacatttagctgacacccttttgtcataactttatgttagcctcttaggtagaaagatttatataataccgcattcatcgttcaacaaactgcacaattaaacatcagtaagatgctatatctataccctcatatataataactgtagtagctattaggttcccataaatatactcccatggtgaggaagggcaataccttacaaaagaatatccgggtaagatcactttttcttcacttccacttccattatgcaccgttagatggtgaggaaacatgtcaaaatgtaaaataaactaaaagctattttcaccgagcacagagagtaaacaagagaaagagccttgagtaatacactgagcactcttgtatttgcttaccaattggttgaatcacggaagcattcggaagtcaattgtactatgaccagaggatacattgatgattcggtgaatcatgctttagattctcgactaattggttcaagcgtttttcaatcgtcagatgctttgctggatcaattattatctcttcattatagagcccattatcacataaacatttctacaaagacaaaattcagtgcactgtcggcccttttatctgaagtggagaagttgcccgttctaaaggatgaattacactgtgcaattgcggacaatatctatggtattgttttctgtgaacttgatgaaaaggaaaaggggttgcagtacgtctctaagaagttaggcagcgttaatggatacgatagatttggaagaatgctagatttggaaaggctattttataagggaaatgtcgacttagctgagttttcctctgaaagctggactattccgaaatattctgatggcttaacttggcattatttgcaggcaataataaaagggctggacctctctcattttaagccaaaaacaccattccaatggatgcttttgacccttaatggttctgcaactgactcaaatcttctatcttatagccattcattattgaagaaaagtcgtttccctaatgctgatgaatcaaataattttgaactagaacaattccacatggtcctacaagagcatctcaaaataaataatttaaatgtgaagaaagaatgggagcaatttatcattgatagtatggaaaaaagtttccaaagtatttcggttgcaaaatcagcaatgctcttttatcgaaaggtcgatctaaagaggagcattctaaactttaccaatttggtcaattattcaaacaaatattacgaacttaacaaaaggtatcctgacttattagacttagtttcatcgtaccaattcattctgtctacatgtaaaacgccatttgaaccgttcttcatgccagcaaacgtatcatccgatttcttaaagttgctagaaagaattcacaacaagtacagtatccctattatagaaaaacaaaaggcactagaaggcagctcagatgtattggacttatgtctagcctcatcaacagcttctgttctatccagttcatgggaaacgttatacgaaactagcgcttcttctctcccagccttggtagatcacagtcagatattttacctatcgaattctttgcaaacgtctttgaacgcttctgtgtcattaaagtttaagttcgcttatcatttggctacattaagacaaattgaccaatgcatcgcttatctaaaaaaacaaatattaacacttcatccagaacatttcgctagttggcatcttcttgcgttatgtgaatcctgcatcaatgaagatttacaagtaagtttcaaaattatcaattctgtcattcaatcaatgtgtgaacttttcgatgaaggcaggcaattcacaattgatgaaaaatggcagtttattcacattaaattaactcaacttcaactagttagagacatgtttgcacttgaagatgcacttgaaattttgccagaggtattcgaactttatcagcgtctcttttcagatgcttcagaaccccttggtcctcaaatcaatcagagtaacgactatctattgcagaagatttggttgtttgcattggaattatacctggaaaatgacgatatcgaaaatgtaaaggctgcgttagatgagtttaagaacgtaacttcaaaatatgttaatttgaaccacaacctcgcacaaggattcgtgttgtatacacatggtcactctgaaaaagcgacagcggaattcgaaaaagttttgcactatgactctacatctgtcgaggcattgatcggtttggcaaaaatcgtgcttcctgatgaagaggcaaacctggatacggatctcaagcataactccaaaataaaccaaaaggagctacatagaaattctgccacgtcactcgaaacttcttctgctgtagccagacttaagttcttattcgaagaactagtcgataaatcgatagaaggttatcaaacatctgcagtgtggtggtatctatcaaaaatatacgaaatatattctgattctaccagacaacaggaggcgctatggcgatgcatcaagtacgaagaacttcaacccgttcgcgaattcaagttctgtaatttctgatattctttcaatttacctcatccaagtgttctgatatccataatatttccactgtggcagctgaagtataacatattacattctagtatatagatttatattgtgactatagaatatactgagttgaattatgtatgacacgctaaattttacccaagcttgtctagtcacctgacttatcgagaaggctaatttcgttttcgatgttgatatatctacggatggaccgtgtccaagatctcgggaaagaagcagaaatgatacctgggcatcctttaatgaattggaaagcgcaataggttaccctttatacaggaagggcaagtggttcgtccaagggtaataatggtttctaaatcatctggatttttaccgaactcttcagacttgcgattgagagaaagaaaagcacaattcgatggtacagaggttttagaggacttcttaagagataatgaacctgtagaggataagctggtgaagccattgaaatcttcaatattttccaacagaaaccaccgatttcacacatatgtttgcttattactaacactggtatctttcgtgcttcggttctacaagattgacagaagcaacatcgttgtctgggacgaggctcattttgggaaatttggatcatattatttaaagcatgagttctaccatgatgtgcatccaccattgggcaagatgttgataggtttaggtgaatacctcgcgggatttgatggtaactttgactttagttccaactctagttatcccgatgaggtaaatttcaagattatgaggcaattcaatgctatatttagctcactgtgcacacccttagcattctatgcagccaggaatcttaattttagtatgccaaccgtttatctcgtagccttaatggtttgtttcgaacactcatatattgttttgggtaaattcgtgctattggattccatgttactgttctttactgttcttaccttctattgtttatcgcagctttataggttaagagagtgtcaacttactgtgaaatggctggcttggattctggccactggtttctccattggatgcgtatgttcagtcaagtgggttggtcttctaatcacagctctagtgggcatttacacggtgtcagaattatactgtctacattgcgatagatcattatccaagactaaataccttgggcattggatagtgagaatttcggccttaatcgtctttcctttgattctttacatggttttcttcaaaattcattttactctgctttataaaactggcactggagattcatctacgcatagtctgttccaagctaatcttgaaggagctcaaataaagccgagccctagagatatagcatttggatcgtgtatctctctaagatctcatggtttaagtcctgggttattacattcacatccacaaacttatcctgatggatccaatcaaagacaggtgacgggttacagctatcgtgatggaaataacaattggattgtcaaatattctagatcgtcgggaaaggcgagcgcagaagaaagggtttacagcgataacattttattccttaaagatggtgacttattgcgattggttcatgaaaaaaccaaaaacaatttgcacacgcatcagatcccttctcatgtttctaaagggcattatgaagtatcaggctatggtaatgatgctgtaggcgatcttaaggacgactggattattgaggttgtcgaacagttaccaactggaaataacacaatggaaaataaagccctgattcatcccctcaccactagttttagattgagaaacaaggagctcggctgttacttggcagccactggtctatcatatcctggttggggttacaatcaagcagaaatcgtttgcaaatatccatggaaccagcgtgacaaatccacctggtggaatgtcgaggatcacataaattctaatctgcacattgaccaaactttcactccacctccaacaaagttttggaccgactttgtggttataaactttgctatggcagcatcaaataatgccttgataccagatctggataaatacgacagaattgcaagtgaaccatgggaatggcctattctctacaaagggttacgtatgtgcaattggaatgataaaaccgtgaagtattaccttctcggttcacctttcaatacttggctgtctacggctgctttgcctatattgttaatcttagtctctatggaactctttaggtatcaacgccaatcactccagttaaacgaaaaaaaagcatggaatttatttgcttgtgcaggattatcattcattggttggctacttcattacgctccattttttatcatgggaagagtaacatacatacatcattatgtccctgccttgtttttcgcaattatgactttcgcctatgttgtcgacttcgcactggctaattcgaacaggtacctaaaagtagttgcatattcgtctctgtacgcggggtgtacctttacttattggtattttgctccattctgtcagggtatgccggagccaaatttaacatatgttaatcttgaattacttcctagttgggatgtaacgaacgcgcagtacaattaatctatttaaaatacttatgcggtactatttagatacttatacactaatctttgaatgtgcttatatttaacgaataaatgcgtgtagatgtgtcagcgcttccgacaccaagtaaaagttttccgttttcgactaagttactccatcttaatcgattgatcttatcagcaggtgtaatagcccaatcaatttcggtaatgtcattaaagctttctgtatacgaaagaattcgaatggcaccgctttcaaaacctacggcaagcaaaaccttttcgttatataaatctttgtgaacggagatggaggttacaggttctgaaaaccgtatgctattctccaattctacagacgtagcttcgtcttcttttgataatctccaaaacttcaacgttttgtcacgggatgcagtaataaatgccaatcctttggccaatggtacccaatcagcatcccaaataattctactatgtggtttttctttgaagcttctgagaacaaagctgttattatcaaagtttctttcccacaaggaccacagtctatctctactaacactcaagagataacgattatcctttgagaatcgtaactttgtgattgtcaaattatggaaaggaagaacctgaggcaattgattccaattctcggcatcaaataatctaattaccgcatgctgagcgttgttagatttacaggccgttgcgattaatttcctatctggcgaaacatcaatacaggaaatctcatatccatgtccatatagcttttcaatttcaggccataaagtgtgtctctgtaactgatcttctaaaggcggagttaaaagttcatcaatcaattcagaagatatgtttttggtttctgcggtttctctggcatctggatcatcatccgattcgttctcatcaacatcggtagtcgctttgttagaaagacctaatgctggtaatgctgcagaatctggaaggtcaccgttatgttcagtcttaatcccgctgaatttttgcagtagctgagcgacggcttttggttcgtcaaaggatcttagaattttttcatctcctccactaacgaatctcgtattagaaatgggttcaacacaaagcatgtcatacccatgaatttggggtctagccatctcacaccaagatggtgtctttctttctacaccagatgtctcatatttccactcagcaaataatcttgtggtttgatccagcgaagtagatagcaaataattcccatcgatagaccatgcgacgtctgtcacggatttcgtagctcctgtaataccaagttcctggtcccataataatccatcagttgaagtccaaattctccaagatccagttttaccattggttagaataacatcctttccatcgtgggtgaaccatatacaggaccagaaaccaccagatgaaccagttgcagttgatgcacctttcgaggatagctcaccgagtctagatgaacagatccaaattccggaaatggtatcaggctcccaaaccatcacagccgtgtctgcagtagaagtgagaagctgtaatttcgttttatgccattgtaacgaagaaatccagtcatcatgacccatgatcaatgcttcaaaatttatggccacatggacatctgcagagatgtcaaacttgtaaatcttattgcttagcaaagtcaacttcttttcatcttcttcagaggtatcaatcttttcattagttctaattctccagagtctaatataacggtcctgtgatcctgatgcaagtaaataatcacccggtactgtttctctgaacaccaaactcttgatccaatcttcatgtccttccaatttggtagcaaattctagcttggacacaccttcagaatttgagacgagactgtaaatgaatacattgacgttggtaccaccaatagcgagaataaactgagtcttctcgatttcatgcattgataaacaaagtggaaatacacctttctggaccgaaaattcctcttgcaaaacatactgatcctcaatgaaagaccagactgagatggaaccatctgcacatccaacaaccagtaaattttttaaaactgcaaatacagtgatagtgtgtttatgatgttttattacttggatgcattcaacttcatccatatgcccttctctcaatttgggaaagttccacactctcacttcgaaatcttccgaagcggacaccatcatatcagtccccttcacaaacctgacacatgtgacttcggcagtatgtcccttgagagtcttgaacacgccgtgatgggaagtgtccatagacttccatagtgctatcgtcttacctgcaccatatgcaacaaccttggtagtctcctctaagtctgagacttgagtctgtttgttggcgccaatgaaaatagattcttgtgacagcattatgctagatgcagtgcactttatggagtactaagtgtacagaaccaagaaagtaatggagcttgtccagttagtgtaccattctatgtaatttgacggcatctcagatttctattactgaaaaaaaaattgtttccatgtacaatgagatgagatgagatgagatgagatggaaaacgatatgaaactaagtatatcaaaagaaaagaacatattaaattagttcaataaataaaccatccattcaatggacatgtagatttatataaatgttttgtaatcaccgtatgtacaaaaaaaataataaatagtaaaccttgggcaattcataatgtcatgatccctatattagtgtttttctggagttcagaagaaaggatgtcttggtaatggtgaaagtgggacaacttcagtccctcaagaatcctatcgctgagctaatgtttgtatgaatcttagtatatcgcatgggaatgaagattagttcaaatcagtcacgcaaccatgggaagcatttgaaaccaattttgcgtacttggataaacatcctctagtataacgtggaggtggagcagtccatgtacttctacgttcagcgatttcttcttctggaactaacaagtcaatcttgttgttatcagcatcaatgataatttcgtcaccgtcacgaaccaaaccgataggaccaccttcggcagcttctgggacgatgtgaccgatcaagaaaccgtgagaaccaccggagaatctaccgtcagtcaatagagcaacatccttacctagaccgtaacccatcaatgcagaagatggctttaacatttcaggcatacctggaccacctcttggcccttcgtatctgataatgacaacggttttttcacccttcttgatttcaccgttttctaaagcagaaataaagcctggttcgtcgttgaatactctagccttacccttgaagtaagtaccttctttaccagtaatttttccgactgacccacctggggccaaacttccgtatagaatttgtaaatgaccacttgtcttaattgggttagttagaggacgaatgatgtcttgaccatccttcaaagatacagccttagctgctctttctgctaaagtgtcaccggagatggtaatagtgttaccatgtaggaagccttcttcgtacaagtatttgataacagcttgggtaccaccgacggtaatcaaatctgccatcacatatttaccagaaggtttgaaatcacccaacaatggagtcttgtcactaattctttggaaatcatctggagtaatcttgacaccggcagagtgagcgacagcaaccatatgaagaacagcgttagtggaaccaccggtagcaatgacatatgtcatagcgttttcgaaagcttctttggtcataacgtcacgaggagtaattcctagttccatagtcttcttgatagcttcaccgatagtgtcacattcgttcaatttttcctttgaaactgctgggaaagaggaagagtttggcaaagtcatacccaagacttcggccacagaggccatggtgttagcagtgtacataccaccacaagaacctggacctggacaagcatgttgcacaacatcttgtctttcagtttcagtaaattccttggataagtattgaccataggactggaacgcagaaacaacgtcaatcttctttggaatcttagcagaaccacaagttggagaacctggcaaaatggtaccaccataaaccataatggaaggtctgttatgtctacccatagccatcaaaacaccaggcatgtttttatcacaagatggaatggcgatattggcatcgtaatgttgagccatcataatggtttcgaacgaatcagcaataacttctctagattgcaaagaatatctcatacccttggtacccatggaaataccatcagaaacaccaatggtattgaattgcatacctttcaacccagccttgttaacggattcggtgattctgttgttgaaatccatcaaatgcatattacatggattaccagaccaccaacatgaaccaacaccaacttgagccttgccgaaatcgtcttccttaaaccccgtggcataaagcatcgcttgcgatgcaccctggtcctttggttcggtgatgatatgcgagtacttgttcaacttcttgcccacatttctagtggttgaaaaccttcttacagcagactgtgaaaacattatctcttaatgatcttcggttcaatgtctatatcttgtttcactttcaggtgataatctttaacaagaaataaaataaataacaataacaacagtagcagtagtaagttagcaaatcccaactattgtacaaagaaaactttctatatatacaaaatacaaacgagaagtgatgtgatgtgatgtgttctgcgaaatcgtcttttcgaatattttttttttttttcattgacaaattttatgactgatggatgagatgagtcctttaaagatttgaagaagctgaaaacaagaacagagtggaggaaagaaaaagaaagctgaattctgtcagctttttggcgaatttcaaactttcaccggtaccggcaatatcgcggagataaaaaaaacaagatgagcacaagcatatataggtcacgtggtccagaaatcgaagcatcgctgttatatctttttgtgcgtttttttttggatcctctgacgagcgacgggcgacagattgttttcatatagggtataatgaattattattatttagaaaacagaggttttgccagccaagcatgctacacggagtgtgatcataattagtaagagagagagttaaatgttgggtgtgacttgtttggtctttgttgctcgatataatatttagtactattctaaactatgccggttttaaaacttcaatcagttattccagagtaaatgagtgtaactagaaagctcaaacaatgtcgattaatatctgtatgttattgcatgtcaacttatgtgggcgttatggcatttgtgttttcgtttccgaccacggttttgaaaaatgggtcaccggttcttgtttggctgagtgggtatagtctaattgtttgtctattctctcattatttggttaaacgcatttggtacacaagacccaaattttacagcttggcagtgatagcagtggtgggtgtttcaactttctttttatcaatgatttgcacttggaattttttatattacagtggagggtatgttcatggtatcaaattttggctatctcaaggatccgccacagttgatgtgacagaaagaatggcactcacaagtactgctggttttgttacatccatatttgagcttttttgcatagttttaatttatcttttgtaccaaaggctgaatctagattgggcaaaagccgtcatgtggctcaagaaggagtcccctgaaaaacctcctcttagtacccagttaacagaaaaatatggccattataacgatcataacaagggtatattggaaggaaatcttgactaaaaatgcaattaacttgtgaaaacctgtagagtaatgattgaatcatgttagtaatatcgatacattatttttacatttttttttaactagtatacaaatttaattttacatcggatataatatcatcatgaactgttcatctcataaccatgccatgaaactttgatcacacttcgccaaatttctaggactcacagcagcactgatagcatctaacacatactgagttgctacacttggagaagaactcatatgtccaaattgggccacctttcttataatcaagtcaacgttcgtcagaacaatggcatataagtgaggatcttcaacaatagaacggttcatgctactgtaccatgaaataacttcatcacggatgaatagagatagataggtgttcaattcatgatctggctccagcaatgccctggcaattacaaataatccaacagagaatacaccttccatcgcggaatcaccgataagcttttggatatttggtgtcattctaaatggaacaggttcattattatggaaaacaggagcggagtttggcaagttagtctcaaattgttttgcatattgattcactctttcataagaataacgagatggtaacatttctaaagtatgaacattacctgatttctcatcgacaaatatcttatgtggagatctattattaatggatagcataaaggtcatgaacacgaacgccgcatactgggaagcaaactgtttacggaataaccaaaaatcttcgaactctgagaataatttggaatagtagtctttcaataaagtcgatggaatgaacaacgaatgaattgaactgaaaatttcaactttcactgcggttatgtcgggagggggcaatactttgtcatgtgcaacgttaagttgttcagtgataaagtcttgaatagcgtccctatccatgttcttcttggcacagaattcgtcataaatttgatgcaatgttctgaaagacgcactgtcactcataacacgtacttgaggagatagtggaacagcgattggtacagtgaattgaatatcacgacgtctagtctgaacatttttacgcaatctctcattcaatagtctgtataattggaacattctttcctctcgcctagaatgacgcacggctggatattgtactgcgaatgaatgtaaagaaccatcgtgcccccttatcgttaatcttcggtgggatgtatgagtgccgcgtgtgaagtcgacttctggcataaacctgccgattttgacaaaatgtgtgttattgtctttgttcaatagatattgtcccggaacttttatatcttcaaacttctgatggtggaaattgctcaagtttggacaaattgcctccatactctctacctttggagctctatcaagtttattctcaagtctgttacgccagaaacgtagtctcttgatgtaaacttcgaagtctggtttactctcaataaaatcagcgttaaatttaacacgaatgtttggtggtaacaaattctctgagaatctgatcaaattagcctccgtgcttgagggtaaaggaggcttctctcttggataaggcaatctgttgtagttgtatgtaccatcaatcaatagaacattaatcaaccggaataaatcctcatctggattagttttgaacttttggttgatttggtcgacaagtgattctaatgacagagcgagtaatggatatgctgtcttcaaaataccattcaattcttcgagatattcccagggttgtcgattgttaggatacatatcttgatcttgggatttgttttgtgaagttgttcttgaattgtctggagatggatgcttggagttctcttgattctctgtttccgcaggttctccctgagttcttgccaaagctaagctctgtctctgtattacagcgaaatcttcttttgttgtccttaactggaagtgtaatgcttgaggataacttttagcaatacggatcaatattttgcggactaaaaaggcctctttatgagaaagagcagttaacagttgaggaatgaatgtaatccaataccaaacaggtatctcaccacggaatgagtcaaatgcgtaagctagtgagttagaagagtcgtctctccctagtagccacaaaattctagaaagtaactttcttgtttttgaattcttatacaagccagcagcttggaggtaacagctcatagcattactagcaaaactgatgttctttggctcttcagagagtctgcgatcattaaagaaaccccattgagcccatgcttttgcgagattcaaatcaatctgaacagcagttgcgaaggcttgattggcttcatcatgggcacgaagcttggagaggaacattcctttcaatgtgaaaaactcagccttttgaacagttccaaagtagactaaattagtgttgctaataacatcgagaccagttgttagttcattcatattttgataatgacatttagcttgttcacgaagtttgaggaaggcttcttgaatttctatgtttggcaaagtgtaaattctggccaactgactgatacaaacatcaggcatgttgtgtcttcgagctacatgagcaaagcgatttatcacccacgcaatttcatggtaacctcggtaagcatgtgtgttaatattactattgctgttagcttgctgtagtgctggtaccaatggcagatacgcactattgataacattgaaaacgtgttgtctccaggtgaccaaatcgtcccaaatagtaatatcatcccaaatattaggtagtctgtctctccaagcctgtaaaacacgtttaatttcttgtgcttttgtgtctagattttgcaccgtagtgctggctaaattagcatatatttgagtggcttctaagaactccatgtactgttggaatgaatgcaataatgccttatgtgctggggtgtagcgttttggtaaggagtgccatttttttaagcttagttgaataccttcatcgcagagacgtctgacttcttgatctccctttttggtttccccaaactgctgtaaagctaggaacgtttcgaatatctgccttcttggagttggtacatccataacactctttacagaatgctctaacgcttcacggtcggcattccattctgcaactctccatccacattctaacaataaatctgtgaatccttcgtgttttgctaactcggtgaggatatcccagtgctgcaatttactggcacaaaggatccagttatcttcccatagttcatattctgactcagaatagggcaaaaagccgcctctggccttgacttgagcagcttcatacatttgctgtgctttatcccataaaccgatttgttcatacgataaagctatgctagattctgtgtactttgcctttcttctccataatccatagaacatatcgtcttcttgtatactcgagtataactcaagcaaagcatcttcgtttgtatctagaattttactattatcgatattggatgtttcttgaatctgttcaagtaagtcgattgattgataccatgcattgaacgtaattcccaaatatcttactagatgaggtggaagttctaacgattcaattttgcttaccgattctaacattgtacttatgacattaacatgtattgacgcctgtttggtatgataatctttagatagaagagcgaccaatgatcttacaaagccgtacttttcattcctcggtatcgatttataagcaacagggaacacatttacccaggttgcgcgaacggcttctggactctgatagaatatatcaactaatgggttaattatgtcacagcatttaatagagtttattttgtcaatgaacgattgatgctctctaatcaaagactccaaagcggaattagtgataaccttatcttcgtcttcaacaataatattacgttcaatagcgcttagtggagatagtgggaagtgctcagtgagtttaattctatgttccatgacacatgctccgaaaagtaactggcaagcttgacttaaccacatataatcggccacaaattcccagttttgatctctaacaacgtaataaagcctttcttttatgtcattatccaaactgccatttaagatgttcattaatttcgaccttaattttatatcagaaatgcgggttccaaccaaaaatggttgttccattctcacggtaatttcactgttgttgtattttttattctcaaacaactgcaatattatttcataaaactgcttagaaaggtgaggttctccacgaatttcaaatgcaagcatctttgtcaatattgccgccttttctttaacagtagggaatatttcattggtgaaaacccaatttttagcgatgagaacaatcttctgcaagaaattctgatccatagaacgatcgattaacaaagcgactgtagacaaaaacggccttctggaatccccaagggtagatactttgaaagaaagtatatagaaaactttcttcaaaagtttcgtggttatacgagcatcttcgacagcggtggcgtcttttggctgggagatggttaaatgatccttacagagtttgttgaaagttttcatcaataagggcaataaaacatcgatctgtgagggaatattaacaaagagtgtccagcacaaaattacacctgcggcaacagaagttgttccattcaaattctcagatatgatggaactaaccaggttcacaaacactttactatccgtatcttcttcactctcaaacggaacatcatcgtctttgacagctgttaatacagtgcttaataccttttgtaaagcttcttgcaagtcatggtggttggcgtgaagacatttatccaaaagggtttggattgtttttagattattgatgatccatttggggtcttttgttctaaaaatgatatccaatacatctaaagcattcatacagtaatacaacaagttggctgattcaagatcttgctggatcaagaatttttcgaaataggacaatttgacaactgcctctggcaggtatccgatggatagtaactcagttaaaacagataatgcctttgatcccaatggcgtttcacaggccctatggttactaacacaaatgaaacgaatcaaaaacgccgcaaatgcttcccgttgtgaaagagaggtagaagaagaggtaactattccttcagaaccgtccatattgacatcggggtcatccttgctttgagccgaaaaggtttgtttttcccagtacataactagatcacaaagatcaatggttagcgtctgattttcggtagaagggttggttaaaagggttaatctaccaatgtatgatatgatgtttggaatgaacatatctttgtaagggaaaaatatgtccttttgacttattaagaattgatagaggatggtattttgttggaagttactttctaatattacccttcttacccaattaacccacgtagttggctcttcggaaccctttgatctatctgctactactggtgctaataagtctaatgattcctttaccataaaccttgcttcaatttgatggactctgagtattgcaacaaaaacttgggttactatgttgactggtagatcgaattttgagatgaacaatgacgtcgttacataagcagcctgtttcaactgaatgtcttctaactttatgaatttccatgcaaacttgatcagatccctttttaccggttcaagcaacgtaggagcgtattttaacaatattgaagtgagctgcaataactcaaatcgaatggaatcaagctttcctatcactgtatttaacacaacagaagaacttttcggattccatatatgctggttaagaaatgcgaaaatttcgttatccggacttatcaattcatccacagagttcttagtggtgctttcatgaatcataatggaattcaccactcttttaatgacgaagttcctagcttttagagaacgttcttctcggagagaaaactgcaaacattctaaaatatattttctttttaactgaacgtcgacacagctgataatatcatcaaagataaagctattcacttcatttgggattttgagatcattatcatacgaatactggatcatttctaagaaaagaggtacatcatattttttctgtttcaagtaggccaaataaatcatttggaatttttcaatactttgattcaattgaagtatatcaatattaaatgaattttcattgataagttttagaacagttgttaacattgattttaactcaaataagatatctgagttctccagtatccaactctcttcattcgaagtgtggtaaacatataccaaatcaattgagtttgcaaaaaagcttactacgcgaacagggttctctgggattttttcgacgtagaatttcaagaattcccttagctgcggttcgaaagcctttctcaaaacaggagcttctttcttttgtattatagaacacataagaagtactaattgtcttgatctcatattagttttgaagtaggtcagtacctgcacgtggaacctattgaggtactttgctaaaggtacacggaacggagagtctagttgtaaccttaacttacgttccagagaaataagcttaaagactaactcattcaaaaagattcccgcttgaggaggaagtaagtgaaaaatgttgaaaatactgcagatgatcttagtcggcgtttgctgagtgatttcctttccgaaaagagtatccaaaacctcgatttggcaccatgcatctaagtgatcggataactttttaccgatttccactttgaagtacgcgataaggagctccaagagttttgctagtgcctccaacccgggtacggttagtttctgatggtcagatagattcatcaacattggtttcaacccattttgcaatagctccttaggtaatttagaattttctgctaaaactattttcagcccctcatacgtcgcttcaataatctctggagaaggttttaacatggttttgaagaatacggctagtacctttattcttatagatccattctgcgcgttagcgaattctgggttcaataaggcttgtgcaagtaacctgatacacacaactcttaacttgattaactgttgggatgtttggtattcggtaattcgttgggtgctggctagtgatatgtcgtcggcatccactaaggcaattgattcgtgtaaaagacggaatagctcctcatcgaatttcaaaaaagagttttgaagacgtaaacaatatatcacggcgtctacattaccaatttgcatcgaaaacggtaatgctctcaagggtttagcaaagattggggaaagtagaaagtttttggcatggttcattaaagtaaccaccgggattttggtcagcgtagatatctttcccaaacattcctggcaaacattccttactatctcagtcggattgcttaattcgcagacaatatcagttaaggaattctgcaaatgtttatcacccaagttttcttctttgacatctgcacatgtaacctcaattacttcatatagcaaagcttttgcatcctctgtgatgaaaagaggggcttcagcatgagtgtcctttaacacaaacaataatcctgaagttagaccgtattgaaagttcttcacataatgtactggtagctgcagcccttgcaacaatgtttgtataccaatcatacccgcacgcttttcgtagtaggtttcagagtagcactgatgaataaaggttctcatgagggtagtaatgaaagagtgctccaggtagagcgtatccccatatatcactttccctatatcatgaaccttttttatcgcttctatagctaatgctctggaatcttcaaggtatgagcacaacccattcctaattgcttttagaaggatatcacagctgatgcttacatctggttgtttcacatcaacgctaaagacatgtggttgtctccttttctctgaaagagcttcgttcacttgcaaaagagagaaatgagtgacaattttattaactaggacagttacatcttcctgcagttcttttatagaggcagcataaaacatgcattccaataaccttaataatagctcttccaagttgttaaattttcctggatcaacaaccttttcatcattaaattggatattgtcttcaagttcttcggaattaagtagcttaacacctttctggagacattctgtcaaattcttaggaataggcccgacggatcccaaaagcagcatcaaaacagtgcttaagtacttgtaagcactttttcgatagaaaagattgactctataatcttttaagatatccgaagcagaattaactccaggagtaatcgacaatggtacttctgagttaaagccgtatatgttgaaccaagcatcaacctcaatgttaagttcagtttcggttttcaggtctttgggtgtctcaataaagcggcggtttcttccacccaacttgcccaaaatacgcacagtcgtatgacttatttggtgattgaatggttgcggtttcaataaatcgaacaaagctttcataacatcaccgacaactggttccaaaatcgggtctagatactctggagttagattgtcgatacataactccaaagtccttaatccttgagttatcaattctggaaatccaaccaaggcatacactaatggcttcattagataattcaaatatggtgccaatacactaagcctcacaggcacagtgagacagagctccacatacaaatcgcgttcgtgagggcgacaagctgtctggatcatcttattgagggactgtagaagagtttgaagtattggttttattgaacgatacaagttttcaaatctgccgccaccaatacttctgaacaatgttcttatcaaatagaaatacaccaaaggctcttcagcctctgtcgaatacttcaaagaatctaaaatcaaattattcaagtgaggtaacaagaccgcctcattggtaatagggaagagattgacagacatgaatgatagcttgaatagtctgatgagtatatttgatttgttactgtccacattccctagttctggaagtttggaattcaagaactttagaagaataccggtgaaattgggagatgtgatttcacttgtcaagaatgattgagcaacatgcaacaaagctgaatcgcgtagtaaagattcgtagataaagacgatttcactctcaacgatttcattgaagacaggactgtcgatttgcatgaaaataatagcgaaataatccatcaactctcgaccatctttagttgctgacacaggtaagctaggtgtagttatatcgaagtgtgcttttactgtggatggatcaatgccctctggattagaagaaaatagatgtagaccagctatacattcatggaacaaattcttcaacacgatcacctcttcgtaggaaaatactcttgataatgcagaccacattttcggattcattgtagtatattcatctgggggtgggttaaaaaccttcaagtcatgaataatggttttcagaaatgaaagaagagtacgatataagtaaaatgcgtccttaagaggatcatttgacgtcgcttggaagagaattattggagcatgattttgtatatcattgaagtccaatatctcaactgagttttctttgaacgatatatccgaatttttatcttgattctttacagtcagtgatgtgttattatcactatgcaccgaactgttacctttctctgatatatcaggttcttcgctcatagtaatatcaccatcgacgtcggcattggtatcaacagtaactgatgacggtaacaattcgtctgttgatttcaagatgttaaccatatattcatcaacatcgtgcctgtctttcgcaagttgatcttggatctccttagatttcttatttttactctgttcgtagacattatgttgttttaatatcttcttatgctgtgaatttaatagcttgaatcttgaagtataagcctctataatcgtcattagtagctttttggccttaggaacttcatatgcgtctttcttacctaaagttaaaatccgttctattaaattcaatagtagcttagcactcataatttgcacagtcaaagccaaagactcatccaaaagaaaactggtgtacattttaacagttttttctatgtcagccattgccaaatctgaccgaatattatgaatgaaatctgcaagggtactgtacgctaatggtctcaaggtttcatatgaagtgaatccatcaccaatcaagactttttggtcaaacatcaaattgatcttgggtagaaacaatttcttataacttgtagagagaatatgtctcgtagcatgtaataattctttacgtgcagatgataattcacttgggcagtcctgtaataatctcatcaccaaatctgggactttcttgacgtgtagtttcaaaatatctgtagcataaccgcgaataaacacatacgctaagaaagaagttgccttgatttgagctaggacataatcacagaatgcagagcggtttttgatttctgacgacatcccaataagtttttcacctttagcttctagttcttctctggatttttgctgttgtttcacttccaaagtgagtaagtcaatgacgagtggtaaaaaagtcggtaagtctactaaaatcaaatgtttatatgatgaaaataaggtcaccattgtaattgggcattcagacaaagtcttgaatgattctgtagctttttccaaatgtttcttggacggtgcagacaagttttcgaaagcatcctcctcattattagagttcgaaaaatcttgtgaatctgcagttgatgagctggtttcttcttcaccaaggaaagtagatgccaccaagttcggtacgttttcatatattccaacgataattttaatgaacgtattcacttcactttctaatggctgcttatagcatttgaacaacgaagtgaggatcttcatacacaagacaccattttcatcgttttctaaggttaatatttttaacaggcattgcagcacttccatggccataggttccattttatcgttaagtggacatctattcaaaagttctagacatgtatttctcaacttgtgttcaggagatgaggcattcattgagatttgatcatcattcaactgtgataaaatgagcggcaacaacttcttcaaaaactcatcgtattcgactgaagaagttacaacatccaaaacatcgtaaagttctgatataatggcatgtctttcagcaacatcttcagtatccctgattctttcgacaaaagtgtccattctctcatgagtatcagttgattccattgcttataagttacaatcgttgcagctcagctatattgaataaagaatcaaattgcagaccgcgtcttcctttgaaattaatgaattagggaggatgcaagttgaaataaaagaacaaaaatgcgaagctagctgatagaacctgttgtctagtgataaggcgctataattgctttggtggttgaagttcgtgtattcgtttgaaatcaatactacgcttttgttggttgagagtacagatttcaatgtcatatcgaaatttgaaaacaattggtaccaagaaaaacaatttgaaaaacctctgtagaccttgaaaagttttgtatcacgtgatgacattcctatttaggaagtgatcacgtgcatgatccgaataacttacccggctattaatttttcattgaaaattacgtatttgttttattctttgccatcatcaacagaaaaatacgcacgaaatgtgaacgttactctagcagataagcggacagccaatgtgcataattttttgagtgtcgaaagatagaacaatggcgaagggtaagtagcgctcacgataactcgtgtttttcacggacaacatcttattaaaacaagtacaacataatcgtcgattaaattcaaggcggctaacttaaacgaatatcgtttttacttaccaactcgaaaaatgaggcaataccccccctttagctattactggaaccattaactgcttctattgattggactgtgtgacgtaatctgtgtgcataaattcacagttcacaaagatctacatacggttctcaaaaaagggttcattcggccagcaccgtacagctctaattaagattcgacaattttgtagcgcttccctgataaccaggtgatagattgttttacattgtaccttacaaattccttcaagaatttaactctatccttgaaaaggcgctgaaagtagctctactacgttgttttgttcttcttcatctccatttcgaaagcctgtaaaaccagaagtacgccttgcattcatgttttttcaaccaaggctcagagtgtggcgtgaaattcacagatcatcatgtagaaaaaatatccttttccatcactttttgcatcacatttggtaaagaatcccgtaccaaatggatcacgtatttgaaaaaaagaaccggaaaaaaactggtgtcaagaatctgtatgacgataagtagacaggcaaaagctttgccagttattaggcaaaagaagttaaggaatcacgaccttgatccgcattatcagtggcataaagaccaggcgtatcagaacccttcaagggaaagaaaataatcaaagccgttaatgaaggcagaaagagagagagttttcctttgacaacttaaaaacctgtgtttccttaggctaataataatcagtgtataccaagtgaaacgtgaatgctgacgggttctaccagataggaacgacgttgtgccccataataatctccatactgtactggttttccttctgttgcctaacggtatttctttttcatcgtgtggtaatgaaaaatacgtgtagatacatactttgaatgcagttctgattttagagttcttttttttttcctgtttctggtatacaaacaaaatatacacagtgtattaaagaaaactgaaaatgtataaaatgacagagttgtcacaccggattagaagcaatttggatttgaagctacaaacgaaaataagcagagcctcgggtgtgcagcatatatcaacagataccgtgtatcctcaggcgcaacacctaccatttcgtgtgtgttaaaaaggtgtttatccttttatatctgtgctttttctttactctgttggtctaattctttccttttggattacacaccataaaagcatagaggaagcgcggtttgttcaacaatacgttcgctatattctggttatttttctttgatctggataattgatatatacaacggacctgcacaaatggaaaattatctggtaagtctggcactggtttttctagttcactttgccctcgctgcagatgctgatacacccagtgttgttgttggaagtgactatagtggattatactatgtgaattccacctttggaacacctggccaagagcagaggcttcggatcgacttgtcgcagccatacatatggttagtgtccggtgaaatttatcctcagtgcaacaaattaggtagcggatgtctaaatggatcactttattatccattacaaagtactactagtaacttagtcgacgatgattatattaggctgcagtttttagatttgatatcgataaatggtactaaatatagagacaacatgaatttcacccaactgtcaacactaaaaaatggaaccagccttaatgacagtaatgtgttatggaacgaaactcagggatggttgaccattaatagtacctcattcatacttgctaatgagactggatccttagttcacggtgctttgggtttatctgggcctatcagtgttcctgccagtgattcggtatcctctttgaactttgatgattcttattattttttgacacatctgaaaaatgcaggtgtaattgaaacttcttcatattcattatgggttaataacgcctccaatcatagtgtagatggtcagattaatagagcaaatgccggaacgctgttgctaggatccgttgatccgaaatattacgatggtgatttgatttcctttggctcaatcccattcaaagatgaatcatcaggttacctctctactggctatcctattgtccctatgtctagggtcagcattgccaacagcgaacaagaggccgtcaacttaacagacagcagtttcttgcaaccggttttcattcattcaagatacttgtacagttatttaccattgagtttgatcattcaggtctctattcaaacgaatgctgtttacgtggaatcattggatcgttggttagttgcttgcgatattggagacatggggtcaaatctgatattcgagtttggtaatctgaatatcagtgttccgaccgtagatttcttaggggcaacctataatatgtattctaattccagtctacgcttcaccaatggtaaagaagcctgctatttgaagatgtatcctaactatgctacctcattcagtgtcttgggtcaatctttcatcaagaacgcttatattgtccatgatgttgataatagtaacattgccttagcgcaggccgcctccgatgaagccgttgaaaaggctgctaacaattcacccgcgaagaagatagaatcgagtacaatcccatatgcattaccaaataatttcacttacgacctggctatgtcaaattccctagcaactatctcatccgtgctactgaatagattcacagcaaccatagcgtcagacggtgaaattttcacaggaaggtcattctatgacacttcaagaacaacaagttccagtgagcacacttcctttataggaccaccaggatcaacaacaaagaaaaactctggaacgccgtcagctgcagctgccagaatacaaaatcatttctcatcactaacatctccagacaaaaacatctggggagtttcattagcattggtcatttgtggcctctttggtttggctttgaccttgtaatctcaagttctgacaactttttttcgacatctaacgaaaaatcaaaataagcaggagataaagacttcacagcaaggattaactatagagatgtagaacattccaattatcacctatcattcagtctaaccattagtttgcatatgttttcagattccttatcattttaactcctgattaatgactttcaattaaccaaggtcaaagttgttcaacgtcgtttaagatcaactgacatctccgaatcgaaccctaaaaatcatttgcagtttataatgtttaatgttgaaattcctttttataaaatacgtacttgtcgcagcaaactgtaacactaatccatcaattctttagatcgttttgtcctgttgaagttttcccctcaattgttgaagctgtagttacattttgaatcaaacacctagcttcaaccgaatgaataaaaaaaaaaaaatctgaaaattaagtaaacatggtaagttgatgaaatcttacatcgtttaactatctaagattaggaagagaatgttttgtttgtcttattaggtataaactgcatcttaaacagtacttacatcaactgaaacttattgttttatatcaccgatccgcagagatcatagcaatattccatgatggctactgttaatggtttagccgatgacgtgtcaaatttgaatctaaatcagaccggtgagggttctatgcagcatgaaacgaagaagcatagaaggcctaacaggatataccataattttgagatggctggtcccagcttcgatcgacattctcctagttctagtcagcaatcaactcctttgatgcaacaatcacagattccatacagcacaccgttatcgaatgacaatccgtaccatcaagctggaacttcagcaaatggattaggtatcaatggattgagtatcaataccttaacgctgtcagcaccgcagccaactacgacacattttgtctcggctcaaagattggaaagtcaacaaacaatgttgcggaggacatttatgacatctattgattctgtccccccattgagcacaacacaatattatgcggaagaccaaggaacagctgatccaagattaatgtcgttgtcaatgtataacgttcctaatgatgaacatctcagagctgctaccaaacttcctgttggagttactgtgcagccgttcgcaaagctaattcctgttgattctataccaattgcagacgcaaccgcagattcagatgggcctatgcgttgtagacgttgccgttcttacgttaactcaagataccaatttacttttgattcaaaaatgatctgtaacttatgtcacataaagtcaaacgttccggtaaagcaggtatctccattagggctaaatgggttacgtgctgatgcctatgaaaggccggaacttttgaagggagcagtcgactttttggtcccatcaagttataatatttctcgtgaaaatgcgccagtgccgttacattatgttttcttactagatatatcggctttcgccaacgaaaataaaagttcacttgcagcaattgagggtataagaaccagtatcgaatatatggttgagaatcaaccaaattgtaaagtggccattattgcttttgatgaatggattcggttcttcaatataagggctgacttggaacaaactcaagaacacataatcaatgatcccaaagacatttttttgccgatcaataagggactatttgcactaccatctgaagcaatgcatgtcattcaagatgttttagtaaaactagaaacgtatatcacagacgagagattcttgcacagaagtcaatcatgttatggtagcgcgcttgaggcagcaaaattagcactagaagctgctactgacaatcaaggtggtaagattatagcctgtttgaatactttgccaacaactggtcgtggtaatctgtctctaatgagagatgatggattgaaaaagcatttgagatgtgaagatgagttttacaagaaattagctcatgatttcttgaagtcctggattggaatagatcttttcgttacttctacagcatatatcgatcttgcaataacatcttaccctgtaattgcaacctctgggcatctacaccactattcgaatttcaacatcaataaggatgaattcaaatttgttaatgacattttagggagtgtgaaatgcacagtcgggtatcaaggtatgctaaaagtgcgttgttcctccggactgtcagtttacaactattattcggagagtgtaaagaatactgatgaggaccctgtaatccctgtactcaccagagatcaaaagttcgacgtgctattcaagtacgatgacactctaaaggtcggagaagatatatgcttccaagcagctctattgtatactgatatcgatggtgtacgtaaagtacgtgcaattaatactaatgcagctgtcaactcgaacgtaatcgaagtcttcaagtttataaaccaagatgtggtgagtagcataatgatcaaagatgtgctagccacattggaagactgtaatttcaatgaaattaggaagaacattgaccgcaagatcattgaaatctttacacaatacagagcactgtgtggcggttcttctggggggcaattaatcttaccagattctttgaaaactttgcccatgtacatgctagcatttgagaaaagtgaattaatgaaacagaacaaatccagctcaagaggtaatgagagattctatgattattacaaacttctcttctatggagcttcgcaactttcatacaagctttatccacagattatcccattgcatgattccttgaacgaagacgatttgagtttctacgatgataaaatgcaactcttgcaattcaataatatagaaaccttatcagtacgttctagtcatcggcaattgataaatggtggctgttacctaattttccaaggtgaatcttgtttcctatggatgaatgaaaacacaaatcttatgttaatacgtgatttgttatcatacgagggaccaatcaaccaactggatatattcggtggcaggttgccagatttagacaccgatataaatatcaaggcccgcaatgtgatcaaaaattggagtcaaatcataaatatagactatcttccagttgtcccattgagacctaacgtggatccttattattctcatgtgatgaaccaactgatggttgaggataaatccatcgagttggtcgaaagctttgataattacttaatagcacttcaccacgatattaaggaaaacataaaaaatgataaatatattaagatcggtaagagcgctgaagatggccatgagaactttgcccagaaattcgtccacttctagagactttttttcttcatcgatcaaaaatgtatataatttttacatagcaaaaaattggaccttcgtcgtgtcatttgtcaatataataaaaaaaacattcggggagtttcatatgtattctaaaacctgtaattatgatttaagtttaattgtcagctctgtacgtgacacaattggcatttcatactagtaaaagacaaaattgactattaacttttcgaaaaaatacagaaaatcgtcaaaggtcgaaaaaaaaacaactaaaatccagagaaaaaaacatttgaatatttccaatgtaaagctttttcatcaatttgcactgtagggagagtaagatatcatctcgttatttgaaagaaaggtcgcgaaagatcaggccgaataaaaagcttttggacccccgacttcatttgaaaaatacactaacaatttggattacaattctttcagtaactaacgccgcgtataagcaaaagaagtgtgagacttattgccatcaatccagataaatcaacagataatcaataaacagaggaacttactgacatgcacagatcgaatagtcagagggccaattcacagcgtccatactctttaaacaatccgttcagaaacgcttcggttgattccagtataaatcaatacgaaacagacacagatttccagaattgggtttcccaaaacacaaagcctatgccatatgctactggcagaagaaatgattccagtctaagtttcaccgattctatcaatgaaacccctgaagaagaagatcacaacacagaagattatttcatcgacctaaacactactaaggatgtaccaagaacgtctcgcgaagcgattaaccgtaacaagtatgtataaaacaaaaaaaaaaagacaaaccaaatcagcaattgagcctgccgttatctgctgataccaccctattactactactaattatactactaataactgtacctctatcatctgatctgctctgtttcgtgtgaatattctccgagcctaaatcccagtgcctttctgcttgtattttccaagagccgtctaaactttaactactaatattagtacgtgccatttccattatatttccttatctagtactcgatcaaatggcaatgttacccgcacttcaatgtgctgtcagatccggaaatcgaaaaaaagggttatggattcaaaaaggatctaggttataattagcaccagcaaatgggcgatctgcttactactcgcagatagcatattggctgttttggttaatattctgcttgcccaacggctgctattaatagtctaagtaaggaaccttgggattacttcggggcatcttaaataagggtgtttctgtccaaagtgttgactcagatacacatacacatacacataggcgtacgcatatatatgtgagtgcagatagcttgtctttgtgctgtgcgttgtgtgttgctttcctttggctgctctcgttcagtgatttttcctttgacaaactagtatttctacatatctttgtcagtgaaaaatctgaaacattaatatggcttggcatggcattccttcattttttcagggtaaaattgcagaaaccgaaagacaaacagaaaagataaaagagatcagttaaaagttaaatgggctgctagacagtagttttaatcttaccgtttacacaatgcattatactaacagtttattaatatttttttgattatttcttgttgtcggttcctcttggtacgcatactcacattcatagccatcttttaggtgaatagcagattgtgataactgtatgcgttcgaagtccgatagtgaaatcaaaataacatttttaatagcactatgtctcctgttccgcgcgcaaactcaaacaacccgttcttgaatgatttgactgaacaagagataaataaaggttctgcggtttccagaactcattcccaaaaacaaactcaacctccaccagcaccccagacctcgaagaaccatatgacctcctctgaagaaaaagaagcattaagaagacgatacctgcaaattgacaacgaggacattgcttctcctcctcgtaggagctcccatagaaataacagtgcaactggtgagatgccaccttcatacgacgaagtggcgggctctaaaggtagaaacgctggctatccaaaggagaagtcatccagcgagagccgttcacgtcacgatagggaaagagagcctagatatggtgatagagaaagagacagagacagagaaagaaggcaacaccgttcagattctgggaatgcgaccagttcgcgtcgtcatagaaaatcttctggggggaaaaaatcaagttcatctcctgagaggaaaactaaaagtaaaggtccattacctaaaaacgttgataccattgataagttagatgttactgggttgtttggaggtgctttccatcatgacggtccttttgatgcgtgtacaccacaccgaaacaagaatgcgaaggccgctccagtgatggctttccctgcagatggtccaaattctagtattgctggcccaactgggaacaagtcctttatcaaagaagtgtttggccataacgatgttgatgacgatgactatttatataaatcaaacggtaaagtcattgtaaattcgagttcatccacagtagatgcaatcaagccaaattctaacagtattacacaattcgatcctaagatgaaaacagaattggttcacggacctaccacggcaggtttgggttccacgacattcttagatggtgccccagctgccactgctctagttagagatgatgctggccaaaaagaatatggcggaatacaaagaaagaaatctctttcgcaaagactaaaagttggtacaagcagaaccgatgatgttagactaaggaaagtttcctcagattcaacaccaaattcaccttcgatgcttgaccaaagtgatagttttgaaagacctcgtgctggtaatttcaatggcaatgacgatgacgaatatttcttggatggtaactcatctggtgtacgttttgatcagaattcaaagaaagaatctacaggtaacaaactattaagaagggttaagagtttgaaggttagtaggaaataattactgtctccttttcttccccttttagccatcggtgtgtttccttgaaccttcatctttccggttacaacatattcctattgtctaagttttcactgaaaagaactcagtttctcgaggagtgttgtttacttactctgcactttttctatacatatatggatgagcagcctttctcgataatatttaaatgtttgcatattcaataagtgataccccatgttcagaactaagaatctttatacatcgttcaccgaatataaaactgcaaactatcgttccaaattttttaccatttataacatttgtggaatctttcatctcctctgtaacattattcttttttatatgtcatttcttttagattcatgctagttattagtgctagatgtttagttgagctttgaagcctgatcgtgctagcacttaaaatgctctgagattttatgaattaagttacgtattaacaagagatatctatgtacattcgttttatttgtttttattcaactgactagtatcaaatggccaattttataaagtggcaaaggctttggtttcaaatgcaggtaatctattctctaccactttccactcaatagattcccaaacgctgtccaaatactgctgctttccgaatacaccgtaatcaggcaaccaagcctttggggatgcatcaatggcaagtaatgggaaatattttgttcctgggtacattacggcatcaacagcagactctactttgtcggccttgaatccttctgtctttttcttgatgctttcctgtagatgtttgaacgatcctgctctgttggaattgaaaggagatccggcgttgtatgtgtttacaatgaataattggtcaaacttgatcgctgatggatcagcagtcttgaattgccttgctaccaaccatgtgtaaccatcccccgatatagcattgttagaattcaaaagtaaagacctgaattcaacgatagaaccgaaagattgaaccaacgcctggtgcaacctttcgttacccatcgataaaggttcgttcccgaaagttagggtcaactctggtgtcttcaaaagttcagatctgttcggtttttcagtgggtagaggtaaagaagaacctttgagcgatgacatcgagaacttcaaattgtatagaagagatgcatagttgaaaatttgtttcttagaagaaatgttggcgttttcatgtataattgtctctaatggcttttcatcggtgttggcagtgtaagaattcaacttctcggtataatactcagctctatcaaaccacgctgattgtaaaccttctttggaaaagagtccggaaagaccacgatctttgttcaaatgctcaaaagatggcacaatgtatgacctaaaaaaggttcttttcaacgttgagcttcttagcattttccttaaaaccactggttactagtgaaggatattaactgcgcaatcagatataacggtgcttttcgttgcaggtttaacaagggctttatcgatcgctccaacgtttcaataatttttcaacttttgattttatctcaaactaggccggaagaccttgacaacaaccaaaaataaaaaataatcaaatagttgaagtcgtgggaaacgatagctttggggtaatgaaaagtatgtgcaatccaatcacgtgattgttgcttttctcaaaaaggtcgcccaatagtgaatgttccgaatgacttctcagggttctaggctggtccagttgggcaacttgtatgccaggtaccatcaagagaaagatattatgatgtcactggtagctagactgcagaaatatatttctagcgcaggctaatactcactatctaaaaatttatagttaatattcggtatatgcactgctggcacgttcttgtttgattgcggccagcgtaagtgtcaagaatattcaaataatctgacgttttacgtaatagggatgcatagatatcgcttcttgagctttttaaggtaattgggactttgcaactctacacgtgttgttttgaaataaaggcaaggaacagaacgcgtaatatatgtttagcatgtgagagtgtattcttttattgaatctaagagtagattgttttctattttgattttcggttcgcaataaaatccagtatccactacacgtgtcgctgtcagttttaaaacacaagtaaaagacaaagacgtggtaaacagtttacagatacattattggctgtcgatatagttcctaaatcaattaccatataaatgagacttcgaaagctttcatgagaccaaattgaaatgtatttaatgtgtaaaataatttgacgtcagaatatggtcctgaaaaatactctgatgtcaaacgtagctcgaacatagaataagagcatataagcagaaactaatagacagaattattagaacaagttatcagtaatttgatttaccatgaactctacctcctcttcttcagaggaagcgttgagttttctaaacgaaaacgtccttggtgtcatgtttggttatatgaaacatgtcgggcaagagtggaacgaaaagatgagagaatctccaaaggttgttggggctagtgtcggtattatcacaccactagttgttcttcttatgttcagcgaatctctccgttccgttgtacaattctgctggcagtgctttttcaaaccgtttacgtcagtgacaagcaacaataatcagcaagaaaacttagaacaattctataaatcccaagccaaactctacgatcgtacaaggggtgttttactccaaggtcgtgaaacaagccttaaattatctctttctcacctctctgaaaagaaaggtaatgtctggattgatgtcgggggtgggactggtttcaatatctcccaaatggcgcttttaacaaacttggatacaacgtttgacaaaatttacttgattgatctctctccatcgctatgtgaggttgcaagaaaacgttgtaaagagcatggatggaaaaatgtggaagtgatctgtggagatgcttgcgattttgaaataccagaggaatcagctcagttgatcacattttcttattcattgagcatgataccaagtttctatgcggccattgatcacgcagtatctttattggatgctaagaatggtatcatttcgtgtgttgattttggtgtcactaatgaatctatgctagtcggaagaaccaacactttgggtggtctagttaacagacatataccttggctattccgtacattctggagattgtggtttgaattcgacaaagtgtttttggatccagctagaagagaatatcttgaatatagattcgggacaatcaaatcattgaattgttataactacaagcttggtaaaattccctactacatttggttgggttgcaataaagaccacgaacaacatcttcaagctagatttgttgaacttgcaccaacatctccatacctcgcacctataaccacgtcagcttcctctaacgctcagccaatgaccaaagctatgattgcagcactagaaaattctaaaaaaggtttaccatatccttctctgttctatcaaaaggagcattggagagtgtactatgatgaagtgaaccctgagtacagccaatttaagaacagttatatatacgcattcacatgggaagatcctagagaagatgttaacattcttaatattcaaccagaagataccattttggctattaccagtgctggtgataatattttgcactatgccactttgcctaatccaccgaagagaattcatggggtggatttaaatccatgtcaaggacatttgacagaattaaaattagcagcgattagaagcttgagtttcacacagttgtggcaaatgtttggtgaaggtaagattgatagattcaacaatattttactgaataaattggcgccatatctttcatcaaacgcatttcaatactggttcgaaaatggaacgaaaacatttgatcctaatggagccgggttgtatgacactgggttcacaaagtgggcattaagacttgcaaaatgggtattcaaagttgcaaatcttacagatgaagttaatatgctatgcaaagctaagaccctagaggagcaaagatctatttgggataaaaagataaagccggtccttttcaacagagtagtgggtaaaatcctcgttggaaacccgttatttttatggagtgcacttggagtaccacgtaatcaagcaaaaatgatgggctcttcaacattgcaatatattattgacactttggaccctgttattgataattctttgatttccgatgataattacttttattatttgacattgaagggaagatattcgagtagaagttgtcctgattacctaaaagagggtggattcaagtctctttctcgtgaaagtcctgaatctcctctagatagagttagacttcatactgacacgttgaaggatgtctgtgagcgtttgtcgaagaaaacagtttcgattgctataattatggatcacatggattggtttgatccacaaggaactgatgttgacgaagaaattcaggctttgtggttggccctcaactctcgcggtagggtattattgagatctgcctctaaaagcccatggtatatcaaaaacttcgaaaagttcggcttcagttgtaaagcagtaagtgcaagataccctggaaaatgtattgatagagttaacatgtatgccagtacctgggtttgtcaaaaaatctccacggcatctcagagcaacaaccgtagattaagttctctcgatttggagaataattaaggaccataacaggcaaacaatttcataaatagaacttgaagatgagatgtaatataaatacaaatgttgaaaaaaaaaaaaaaaaaaaaagatacacaaatgaaatgaatgaagtaatatgcttattttgtctctttgcactgagttcgctttttgctttcatcttcagtctttccaacttccttcaaaaatatgcttaacaaatgccatctcgtcgttgtcttctttagcgcccattgttctgatacctggtgagaaagaagtaatcggaagtaccatgatgtcgtccactagaataggctctgtcatcaatgaaaagaatccccagaacaatgagggtttgtcgttttgtaaatttttaacaatgtctttatagaatctcatagttgtatcatgtttggatccatgtttgttgataacattaagattatcattgaaaattaaaatgtcatcattcttctggataacgttattaagatactggaaaataacatctgaaaaaatacctggaccagtccagttcataatatcggtaccatctgtatttttggcggttttcttttgttgatgtttgtaatttttgttgaacttctttttatccctcatgttgacattataatcatctgcaatgtcttttaatacttcagcatcatctaaaggaatgctgcttttaacatttgccacgctctccaatgttgttgcggtgatatttgtgatcaattcgcgcaataatggatggccagattttgattgtattgtccactgacagaattgtattctcctggcgtaccactctgcccaatcgcttctatccggatcagcctcgataccaatgacaaagccaggttctgaagcttctagcgtttcaaggttgtccaaggaatttctatacctttgtggattctttaaactagaaaagtaggactgagaagtcgatggccatgacgacaatggctttaatgggaacgtatccatgtcagaatatataccacctcttgcataaaggatcaagtatctgaaaaagtctgctttaagaattggaagtggcaaggattcaaaagcctttatcacttgtgggaccccaccatatagctgctctagaagtggtatcatttgatcatctgtgattaattggtattgatatggcggttcctcggatgcactgaaatgtttccaatcattctggcattttgaaatggaagaaacctgtgactttgaactgggatcaatcttccaggtctgccatacctttttggggatgggtactcgagaatcgtaggggaattgactagccaattgaactcgtagatccatcaaatgatcaccgttattgctcgtacctgctaagtccaagtttttcaagttcaagtgatccacgcgagctgtactgggaagcaccgtgccaatgctgttatagaaatggtgattcactttcgcagtattccattgcacagaaaacaataagtacagtatcagcacaatgacaataatgtacctcgttcttcttgaaatctttggtaaccccattgtgcctgtaaaattaagaaaatgcccacaaatttaatgtttttgggatgttgtttgtgaatcaaacgattaattctctctatcgatccctaagaactttttatcattcaatgaagaaaaaaacaacaaacagcaagaaaaaaccaattttctaaacagtaaacccaattaaattaatgtttcgcacacgctccaactgttgttaaaacctacacctcttgatctatgatacgaatgtatatatgtacagaatgtatatatgtacagaatgcgtttttctttgcagtggtagttaatcatttgatgagatttcagcatgaaactatatatgaaaaactgaaaaaaaaaggtctatacaaccttagcgaagtaaaaaatctaaaaaaagcttttgtactggccagaatcgacagacgggcgatacggtcgtttgaccaagagaaagaagatgcagagggcaagtaatggattcagggttcagttcaatgatatgagttcatagaggggttcataaatacaatcagcggtcgacgtgtacatagcgggtattatatgtcttgtgtatagttttgaagtttcggtccatataacatgtccagatcagatggactcttgaactgagacctcatttttggccaattcctggatgaacgattcaatcgattgcaaatcatttgcgatagctttagtataatccttgagtatagttacatggtaaccaaggtttgcagcgcttattgctgagttttttacgcagaaatcgaatgcaagtccgaccacatagatttcagtaacatcattctctttgaaaaaggcgtcaagttcagtgtgatgatcattccagatatcgttgaatccggaataatactcacgatccgataagtaacctttattgacaatcttatgtggcaccttgagctttaaaatttcagcgagtaatttttccggaacctcagagccccatgtctcctggacacaatggactggccataacgtagcactttgtttctcggtgctcccaggaacgggtgagtcgtaggtgaatgaactgaaatctggtaatccatggttctttgcaaaagaaatgtggtctggcggatgccagtctttagtcatggcaacacagtcccaatcctgatcttgcaaaagctggatgacaggatcgatgatagtatcaccatcttgaactgccaatgatccttttggtggtaagaaatcgttctgaatatcaattactaataacgcacgggctcccatcgttaacaaatacggagtctcgattacttagtgatgtttgtgtctcacgttttttcaccgttcctttattatctccctaatttttcaaacggtttgttttttcagtgcaattttcccttcaagtatgtgctactttatatactaaatacctacctaaccgagagcaatgttcgtcgttccgcagaaaatgaacagtcaagacagtggttggtgctaattgcctgccttgtatacattggatacactgctgctttgtacggccgtagcatttacaatctgaaacatatctactttatactacgaactgatcaacccttttttaatttttcgatccttttttcgttattgtctcatagtattgggcgtctaaatcttgagaaaaaagaatcttctgaaactatataaactaaggggttttatcttggatcttaatcaagagaaataaagtaatgattatcccgaacgccagaagtgacattacttcggcatattttggagctttgattgtaaaaaaaagcaagctttctttctggtaaagatggatggcatatcctcaataagtttacaaccaattcagaatttagatggcttatttcggatattggcggctaaagagacagacgatttacacaggattaatgtttggtataaattacttgaaatattaagagtagccgggaatcaagcggtatgtatcgatcaatcggtatgtgacaatttattgtccagattattggtttctgtttctatggttgatgccgttgaagaaggtattgatttgtttggagtagcgtttacttattgttccgtaaatgaatcacttcaaacacttgtatttcaattcattagtcaacttgaagaaaattctaatttgaatttattattccttaagacttgcagtttacgaccccataaagatcatgttcccgggttctacgatataattttccaattacagactttcaaaacattggatgcaaaggtaatgcgattcttagaccttaacttgggagatgtcatattaaattcatggattccgtcttggaaatcgtggatcgactcttttaggaataattgtaaagattttgacgttgttcattttttggtacaggaaagaatactaattaaaactgtgcaacgtcatgaattggatatggcaattgcaaactttcaagtttatcctagaaggttgaaggccttattaaatattaagacggaagccacacaatatctatctctcaaattcattagaagatccttaaagttctttaaatggttgaataaagacttgcaaggaactgtcatatctttttccagcaattctatgaacaatcacaccttcgaacaactctttcatgataatggagaattctatttgcaagtgatcatggagattgtcgatcatccggaactagaactcttagaggaatctcatctgttactgttactaagagtttctttgggacatgtgtgggaaaagtgtatcatgtcaaatcaaatatcagaagtgcaccatactcttggaaaaatgggaacaacgcagtcattgccgtctttaattaaccttttgcaatatattttatcgaaatactgtattaatgtaatggaatgcattaataacggttatgaaatggaaactaattccctttggtacagacaattaacgaacttggccatcccagcatggtttgaagatttgagtccaaagattccaccagtatctagggcagtatttggatttgatgacaacaggattgaaaaaggacaaatgattaacagttttcaagagaactttagtaacatttttgagtgtatgcaactcactttatctttaaatggagcacttttaacctactatggaaatattggcttaaatccactatgtctcggatcgcaagctatgtcaaattgcatttctgatgtacaaaataagacagtatcaatgcatttcacaatttacttcgttcctctttttacagtgcttttgttatcccaaaaattactcgagactgacggcgctagtaggacttttttgaatactgaagcagctctagtagatgcaaagcagttattcaggcaatctattaaacaaattgagtgtatcattgacaatcatgggaacaatggattgtaccatcttatcaagtttgtgtcccaggtaagcatagaaagtttgctctttcaggacatctctatgataatattacgccatatcttctttgagagtgatggacaatggatcttacagttatgcttagcaaatgaactgacaactcatggtttgcttgattacatcgtattatggaatgatggatcaaaattgtatagtcctttcttcacagaaatcttcaagcaaccgcaaccagaaatccttagaaaaacagtagtacttggtgacttgtttgagctacttatggaaaaaacgaaacaaccatccaaggaaggcatttcacatcctaaggtaagatcaaaattcaacactaacgcaagctctttcgttccacaagatactagtatgcatacccgcacaccgaagaagattgaacaaagtccacaatatcccgtgcatccttctctcagcagctatggattcaaacctgtcagtgttagaacaacatccggggtttctgcaggtatgaatacttcgtttgcagattgcttttcgggagtgtttaacagcgatcagcaatcaaaagcccagatggtgcagaactggagctccccacctccagtgtcacaatacaatcaggtaaactccacgaaacttgttaatactggcaaaagctacatcctaggcgggcataatagagcagtcaataatagcaggactaaaagtgtacatgttgatgattttgagcagcgttgaataactaactcgctataattcgcggcaaattgaacgacaggaacgtcaaaaaatgacaaatttcgagtaagaaagatcttaatcacgtaaatttgattataaaatcatagaatgctgcgatcaacggacccttacgatctctcgccattttgatttatgctccctctttataaccaaccattttaggagagaaccttgaaaagaataacgaaatgattatgagacgataggtaaaaaaattcattcagtagataaagtataataattacaaaaaaaataaaatagtagattgaataagaatgaagttaacttgagctagaaaaaccgtctgtactcaagcgaattaatcttggaagaaattggaaggaagaaaagtataagttcgaccctaatcctaatgttgcacaaacatgatgaaaaaataaaaaaataagagaaatgaaagaaaaaaaaacataattacctataatcttccgtagtgtgaaataccttcatctaaaatcccaatgttgaaccactcatgttcaatcacttccttcgccgttattcttttcgttggatcaaattcaaacatcttacgacataaatcaacgaaataataccaaaacatgaaaacgttcttatcaatatttctggaatcaatattttttgataaaattagacgccagttgtcctctaactgcatatcccagtgaatctccagccaagatccatagtccatttgtaactttttggagataaaaacatccagcctgtcacatgttgccaaaattcttttccatgacttttctttggtaatgacttgaccttttgaattccggagaggccaccttaattctcctgtttgtctgtcgaaatattttacaactgaagtttgcaaatcagttgggatgctgccatacttgttttcaactttgaagaacattttttcaaccatctttttagggaatttttcattgttgatacgttgcatcatagccatatgctctgtattttcatgaattggatagagtgactcgccagtaactagctcaaccaatacacatgctattgaccagatatcgcatgggaaagaccatccaagccctaaaacaatttcaggagctctgtagtgacgcgttgaaacgacaggtggatggtattcattgtagaatacagcacttccaaaatcaattaatttcacctcaggatttatgagtatttttctctttccaccgctagccagtttccttctttcagttaaagagtctatgatttccattggaagtgactgttccacgcaagtttcatcacatatcaatatattctccggtttcaaatcagtatgtattattcctaaatcatgcaagaagcacacagaacgtaccaactgtttaccgatagcttgaacatgggaaccagggaaccttgcatatccattgtttgtcataaagtcatacacggacctgccgtataaatcagtgaccaagcatatgtgattcttgtaatcgaagaattctcgcaacagcaagcattgatattggccactcctgtcattttcctttatagtctgcaagacacgtagttctgtctttgcagcttgccgatatctatcgacagctcttatgattttgacagcaacagtgatatcgtttaaatagtccttgcactttaccactttcccaaaagtaccctgtcccaaaagctgcatagcctggaatctgttcttggcaaaaatgtcattctcctggtatacataatgaccttcctcatcagttttgaatctatccatagaacgtaatttgtcctgatgggagcccaatagcggagatttctttaaaattttggtgaacctggatggagatttcgaggcagaatttgagatgtcaaagttctggtcctggttattgttttgcataccaccattttttcccaatctgaaatcagcaacaggtaccggagacaaagatctgatcaatggcaatttaatcaacttgttcccatcaacagtttgcgtcgtagtaccgctgacatgcaataactcgtcatcattctgtgtcctcctatccgtatttctgggttcgtagagtagtcttgcatgcggtaattgtggtaaagagactgttctttgcttctttacctttttggcactcgtatagttgacactattgacaaactccacggcactgtcgtccaaatctacaagatcaaatccgttcccgttttcattttgtttactattcctattattagcagcgataccggtaacaaaagatcctgaattctggccctgtctgtcaacatccaacagaagcgtgccccttaacgaatctgccgtcattggatcgttgttggatgacataaattcctcgatgaacggattctgcatccgtccagtatttgaagcagaagacgttgagacatctgcagctgcggctgcggctgcggccgcagctgccgtcattataggatctgacatgtgtccatccatatattgtgatctcagtgtcgagctttcattaatgccttccaaagtcctggttcttttcctcttggcagcaaaattctttgaggccatcgtcataaattagtttcctgcggtggaagaagcaatttctcaattaaaaaatgtgcacttgtcctatgctttttctttactttagaaaggagaccttgatccctctcctgcaatgttattttatttttaaattgctaatctttcaatgataagcgcaaatccctcgtccagctaacactatacctcgatgaaacgtacctgctctctctttaaatgtctgtttagctttgctgaacaagtggtctgctaaaataatacttggcaaacaccgtcatttatatatagtatatgtatttattcttggagattaattaaattagtgaagaatcatggtttaatcatttcgaggggagaatccatcagaacggaaattttaccctgccaaccgatgattcaaaaaaaaaaaaaaaaaaaatttggcaaaaacactcaagtgcaattttttcccaagaaacggcagtaagaggagaaacaatacgtcgttagatgcaatacggctacgtgggttattgattattaaacgttggttgttgtccatatatagctataaaaaagaacgtggtttgctagcttcttatgagcgtgcgagcaagagttgcatgggcagccagcctaacctgatcccgataaacctcagctaccgagctgctctcttctgaagcggctttgcaagggttacggatgatggtggtacgtaattataaagtgggtacgtctttgctgggtgactggaatttcatgtttctgtaagattctcgggagggtaacaataatgattatgataacacccaaggccgttcaacagggtctgggccctcctcgaaacaaaacaagttttgggccatgtatcatcattatttacggatgtgtcgtgtgacactgagatcttcgctcttatttaccgtaatatacatataccaatgcacatatctgtgtgctttatatgtataaatatgtaaatataaaatataccatcctaattacctgtatttcattctgcatcatattgtagtatacgatttgtataaaaaagttcaaaagcttattatcctttaaggttaaagataaaaatcaacacttgtggcacttgtgtttcttctcgtgtcttcgtaaattgctcttgacattgtagctcttgttacaatcaagatatgtacatttgaacggtttcgcctgtgaatgcaccactatatgtgttttcaaagtgcttggacgagagaattctttcccgcaaatgtggcatttcttacagtgtattttcttcttgtaacgagccccacgtccttgcttttggttccattcgtggatgtacccgggttctggtctatcgtgcagtagcttttcttgcaattgtttgaaatctaactcagacaatgaatctgtggaagagcatgaagagtctgagtgggctctgggcctaaatattgcgtcacttgtgtctatcttattttcagcttttacttttttctcatcggcaatggtcaacgggggacttatcgagagtttagttattggaggtaacgtccttggtgtatcatcgaaattgtctgtgtctgtgtagtttactaagttacgaatggatggaagaagcgaaaattggttacaacttagtgtcgctctgcctcgattttctgccatttcctttgggctcttgggtagtggtaaaatcatcttcttatccattatgtttggttttatttttatgttatctttttatttgcgtcagcgtgtgctgatcttatcccacggccttttacgtctcctccgctggtcaactcccgtaaagaaaatgctttttatatgcatatatatatatatatttatacactgttacatggcttcagacatgtgccaagcgggtttactagaaacctaccaagaatgtcactagattgccgttatgattggcatatataaaacacgtttttcccttgctcatgactcgtggtccctcgagtggaagagaacaaaaattaattcccaacaaagtacgcagtactttccaatcattaccacgtgaacttgaacccacatgcagcaccatgcacggtcttttcttgataaagaccgtgcttttctaacaatttccttttcgttttacttaagatgaggtaccttattaacattacgcagatccatgttcggcgtatttggttccacgtgggaaattcacgtgttggctgataagctagttatcatttcgggacgccctgggttttttaaaaaggtctgaaagtcatttgcatccccgaaatctgattttggacgattacccctcctgttacccggacatgcgacggggaaatagacatgatctggcccaagatgttccgtcataactgggagagaacctctgtgctgtaggcctgatgaagacatactttagaaacgaaatacacatacatatatatcctggaaaaactgtttacgtatggtatatatcaaattttaccctgaatcacacatcacattcttacccttaagagatcaagtattttatggtattggtggcgaagcttatcagaggatttgtaccaaatcctaggcacggaaaacttgcgcaaatgtgggaattcaagtgggtacattttcctcatttttctctggtacctatggatagcagcttgtaaatttactctgaacttgaatagtgattgtcgttgacggggccattgcgtctccttgtagctatcgaatctctgtttagttagcgagtagaaagcagtgatccggtcttctgctgtttccttcgcattcttcgtccattccttaacgctttcgaagttttcacgcctcaccgttgtactgacccagttagaagttgctgcataagtaaatttcaacttcttctgacatacttcgtaatattgctcaagagaagggaagctagggtaatatgatgctaaagtggatggaagtggcgttttcttcacgtatgctgcttcgtatgcatgggccctatggcccatgtatgcatcaaattgacaagccaatctgtccttgaaagctagtgaactacactctaactcgttgtttttagtaaaactgttaatatcacggatgaaaacggtcaagaggcccatgttgatgagaccggccaccaacgaaattccaagaataacggattgaagtttcgtcaagcgcgctgtccatgtattgctccttgctgttgtctttgcaggcgcaacgttggataatgaatccagtggcgtggataacgacgtagtattgttactatgattaacgctccctttcttattctgcaacactgcggaatcctctaagtcgctgcttgtcaccgataaaatatcgtccatttcaccagcgtcaagatccctgatggaatatgtaccgtccacaccaccaacgaccccccaagtgtcatttccatccactgatgtacatctatcttttacttcagccatcgcttcgctttaatcaaaaaaaaaatctcctagctccttgattttacgcctgaagcttgatctacaataagtttatactgacagaattaatactaaaatgtcacacttaatatgtctctgatattccaataatgatagttagttgccagcaacgttctaaaattcttatcagtcctatatatatttcttgagtataatcacaaaaccaggacgcctttcctttgttctttgtttcacattttcgtttccgggaaaactgttactccttgttaaccattttttaatccttattccttttatatttgtcgtatcaaattcccttttttcacaactcattgacctaaataaggaagggaagataaagggagcctgagaagagaagactgcgaagagacaagtggcagatgcggtgcaggtgcagtgcatgtgcaggagttagtgatctgcatcaataggtaatatgttcttgaacgctttctttttttatagtattaaaagaataatatcgactatttaactattatttctttacacttctgatgcagttctgctattctttcagctgtatccatgaatagtttgaactcttcgattagaacgctgacgataatgttaacaccgaccttggtatcatcatcttcggatgaatcgttcccaaagagatcattctctagacctgacactgcgtcgtcaatattgcttagagtgtcgttgtagtcatttaatttgtgtttgtatgtgattaatttttcctggaagaacttatctatctcaacgtttgatattttgaatcccttactgactagttgttgcaacattatagcaaaattttccaattgtttaacatctttatccactagtgtcttgatggcatcgattcgtttcaaatctgatgatagtgatcttgttgcgttgaaatgcaatttttgtagatacttgatgtcacgagggattgaatccaatagttcagtttgatcttgtagatcagcttcaagatgtttggataaagacacttgcgttctaatgaattggtccaattgttcgatttcttgacgaatttgaatcggaagctccgatatcttggtcatcggcgtgatagctaattggttaatgaaattaatggcactctgttgagtctgttgtatctgttgttgtggtggctgttgaaattgattttgtgtttgtccaaacattcctaaaccagattgttgggattgctgttgttgatttccgaatgggcctccggtagttggtttggatccaaacaatcctccaccagttgcagagcctccgaaaccggtagtctgtggttgtgctggtttggatccaaataatcctcctccagttccagagcttccaaaaccagtggtctgtggttgtgctgacttattcccgaataagcctccgccagacccggctcctgagttaccaaataggccacctgtggagccagtggctgtattattagaacttccgaaaagtcctcctgcggtttggttcgtattgttgttggtgcctgctggattactgccaaataatcctccgccagtctgtgtcgctgtattgttattgtttccaaataaccctcctccagtgttacctgatgtggcattgttattaccaaaaagaccaccgctagtgctttgctggttgcccgtattcccaaataatcctcctcctgtgcttggtcctactggaggacctgtagaagaagaacggccaaacatttcgtttctatcagtaataagagtattagatatttacacgccgtaaattcagttaattcaacttactgttcagtatcaattggtgtctcaattctgctctctccatctttctttttaacctcatctgtttactttctcagtttccatattcaaaatgttttcaactcttccatcaaagagtataaaacaagaaaaaaaagcttgaacttatggatccgggtaacccataaacctcgtctcaaaaaattttgccaccaccaagaaaaatattccgattgaacattggaaagaattaccaaattaccttaacgattatgttactaaacagtagctttggttaatgtactttcagggtctttcatccatatcagggtatattataacaattcactaaaagtggttactcattgttcggcaacgtatactactggtactatccaatcccagttgttgttgatcttttctattgttggaggaaaaaagtcagtaaagcaaacctcagaaagtgttcaattaattacggtttgtggcttaactaaaaatgggtattccaaaattctttcatttcatctctgagagatggcctcaaatttctcaattgatcgatggatcacagattccagagttcgacaatttgtacttggatatgaattctattttgcataattgtacgcatggtgatggtagcgaggtgaattcaagactatcagaggaagaagtttattccaaaattttcagttatattgatcatcttttccatactattaaaccaaaacagacattttatatggcaatcgatggtgtggccccaagagcaaagatgaaccaacaaagagctcgtagattcagaactgccatggatgccgaaaaggctttgcagaaggccattgaaaatggtgacgagttgcctaagggagagccatttgattccaacgctattaccccaggaacagaatttatggcaaaattaaccgagaatttgaaatatttcatccatgacaagatcaccaacgataccagatggcagaacgtgaaggttattttctccgggcatgaggttcctggtgaaggtgaacataagatcatggattacatcagagcaattagagcacaagaggattacaatccaaatacaagacattgtatctacgggttagatgctgatttgatcatcctaggtttatccacccatgatcaccacttttgtttattaagagaagaagttacttttggtaaacgttcgtcttctgtgaaaactctagaaacacagaacttcttcttgttgcatttgtctatcttgagagaatatttggcattagagttcgaagaaataacagattctgtgcagtttgaatacgactttgaaagagtattagatgatttcatctttgtattatttaccatcggtaatgatttcttaccaaatttgcccgatttgcatttgaaaaaaggtgcattccctgtgctattacaaacttttaaagaagctctccaacatatggatggttacattaatgaacaaggtaagataaatttggcaagattttccatttggttgaagtacttgtccgattttgaataccttaactttgagaagaaagatattgacgttgaatggttcaatcaacaacttgaaaatatttccttggaaggtgagcgtaaacgtactaggatgggtaaaaagttgttgatgaaacaacaaaagaaattgattggcgccgtaaaaccatggttattgaaaaccgttcaacggaaggtcacttctgaattacaggatgccgatttcgaaattttccctcttgaggataaagaattggttcgggccaacctggatttcttgaaggaattcgcatttgatttgggtttaattcttgctcattctaaatcaaaagatttgtactacttcaagttggatttagactccatcaatgtgcaagaaacagatgaagagcatgaagcccgtattcacgaaacaagacgttctattaagaaatatgaacaaggtattattattgcatctgaagaagaattagaagaagagcgtgaaatttatagcgagagattcgttgagtggaaagatcaatactataaagataaattagatttttccatcaatgatactgatagtctaaaagaaatgacagaaaactatgtcggaggtttacaatgggttttatactactattatcgtggatgtccatcttggtcctggtattacagatatcattacgctcctcgtatatcagatgtgatcaaaggtatagatcagaacatagaatttcacaagggacagcctttcaagcccttccaacaattgatggccgtcttgcctgagagatcaaagaatttgattccagttgtgtacagaccactcatgtatgatgaacactctcctatcttggacttctatcctaacgaagtagagttggatctaaatggcaaaacagcagactgggaagctgtcgtcaaaatttcattcgtggatcaaaagcgtttagtagaagcaatggctccttatgatgctaagctttctccggatgaaaagaaaagaaattcgttcggaactgatctgattttcatattcaatcctcaggtagacacagtttacaaaacaccactagcggggttgtttaatgatattgaacacaatcattgtatcgaaagggaattcattccagaatcgatggaaaacgttaagttcttatttggtttgccaaagggcgctaaactcggagctagctctttggccggtttcccatccctaaagacactaccactaactgcagagcttgcttataattcttctgttgtcttcaatttcccttctaaacaacaatctatggtgttgcatattcaggacctttacaaggaaaatggcatctctctgtcagatctagcaaaaagacatatgggtaagattgtttattcaagatggccgtttctaagagaatctaaacttttgtcgttgattacagaggaaactgtgtatgaaggagttaagtcaggcaaattaacaaaggtcattgaaagaaagcctcaggattttgaaaggaaagaatttagagagttgaagatgactctcaaatcgaattatcaaaggacaaaggccattcttttggatgacatttctgctttggctaaagtggttccagtaaatggattggtgagaaactctgatggttcctattctaagtctttcaatgaaactatcgaatactatcctttacaattaatcgtagaggacgtaaaaaataaggacgaaagatatattgaaaaagagccgttaccaattaataaagaatttccaaaaggttcaaaagttgtgtttttaggtgattatgcgtatggtggggaggcgaccgttgatggttataatagtgagactagattaaaacttacagtcaaaaagggttctctcagagcagagcctaacatcggaaaagttagagcgaaattggattctcaagccttgagattctacccaacacaagtgttttcaaaaatagctcgtgtccaccctctcttcttgtcaaaaattacttcaagatatttggtcaatgattctaaaaagaaaagccataacgtcggtttgatgatcaaattcaaagcaagaaatcaaaaagttctcggttatgccagatgcagctcaaacaaatgggaatactctgacgtcgctcttggtttgttagagcagttcagatctacattccctgagttctttgcgaaactttctaactcgaaggaacaagcaattccatcgatcactgatctcttccctaacaaatctagcgcggaagctgattccattttgaaaacagtggctgattggctctcagaagcaagaaaaccattcgtggtggtgtctttggaaagtgattcgctaaccaaggcttcgatggcagctgttgaatctgaaatcataaaatacgtttctttaccagattcaagcgagcagaagaaattagctaaggtcccacgtgaggcaatcttaaatgcggaatcgtcatatgttctattgcgctcccaaaggttccacttaggtgatagggtaatgtacattcaagattcaggcaaggttccacttcacagcaaaggtactgtcgttggctacacttcaattggcaagaacgtctcaatccaagttctatttgacaatgaaataattgcaggaaacaactttggtggtaggttgcagaccagacgtggtttgggattggactcttccttcttattaaacttgtctgatagacaattggtatatcattcaaaggcatcgaagagtgctgataagaaaccaaaagcagttcctaatgataagcaagtcgccctcgcaaaaaagaagagagtggaggaactcaaaaaaaagcaagcccatgagttgttaaatcatatcaagaaggataacgcggaatcaaataccgaatctggatccgctccgcaaatagcagttaacactttaaatccttcggctgctaacaacgtgttcaatgccgtcttgaaccaaatcaaaccaggttctcaacagcaaattcaaccacctccagcaaattctctgccttacaatttcactgttcccccacatatggttcctggtggtattcctcatcctcttatgatgcagccgcctttcattccgaataatgagcatattgcttatgcagctcctcctcagtcacaacctgtacaaaatccaccattagataaagaggcatccaggaatcttaagaatctcctaattagagatgagaatggacgtacagcaaatgtggagaataaagactcagatgatacaaagagatcttctcattctcgtggcggtcgtcgtggccgtagtaatcgtggtcgtggtgcctccgggaggggtggtcatttcaaaaattctcctaaaaaaactgaaacctgaatgttggtttgaatggactattaacagtaaatattatatcacttcagtaaataatgcttagtatataagaatagagacactttcaggttcaacttttcaaaattcccggtttgttgtttgttcctttattttttgatcagcgatatcgtgactcttagcaaaccacttagtttcaaacccatttgatctatcaactccatcccatctataaccgggaacgataccgaaccgattttctggaaagtttttctcgtaaagccttcgacccaacagtgacgtattcgttcctcgcagggtgtttccttgattcaatggatcttcggttgataataatgcacttttctcagttttgcgatcaagttttgatatttgtacttcgcctatatttcgtattttaagttcttcttccttacgtactttcgctgtcaaattagccttttctcgaagtttcaattcttcttcgtatccatctattaccttacctttttcgtctctatatactgtgttctgattcttcttgagaagccctgatttttgcatagaaagtttttccttttctgcgatctgcttttccatctcttctgctgtctgtaacccagcaaaggcgcctgacgacatcctttccttactatcgtcctttttgtcgacatcaacgtgttgtacaagttccaacttttcagtttcaaggtttttccaaagagactttcctgttttatttgagcttgcagccttcttgttttcttcagtaataagattagccttgtcaataatatcaatatttcttgatgtgactcttttagactcatcgctctttctgtgtgatgacttatccttagactttttcgtcttctctttaccgtgctttgagccgtaagacttcgccaaaaaatcgttaagtgacattatattaattgggtcggtttgcaattctacccaccctaaatgctgtgataagctctacagctatgtaaacatctgagaatctgcttctgttggggagctctatagccatgttagccttaatctgaaatcaaaataaggttttcttttccagaaaaaagcataaaatatcaacaatgtaactgttagttcgataaagagctaaggtttcgcgtcaccactttgtactgtagctagtttgttagacccttactgtggacacatattgagttctcaggattctgcttggcaagaatctttactgcgatgagtcaagaatcagaggaaagcctagaggcatggctacatcgattagaatggtctcagttactttctttacaaaaacaattagtatcggaaatggatcgacggtacgtcgaaataattcagccacagggacagaatattcaagatgacttggatgaatacatgaaggacggtcttagcagctatgatgacctcccgtctactcagtttgatccaatacatgtgaagaaaaacgcgactgtgaaaagtactattgaacaagaacacgctgaaccattggcaagagaacgtaatcaaggactacaacgtgatttagagctgatgagttcccctttgaaagaaaacgagattatccttgattcccaagcgtcagacatcttgaaggagaatgatatcaacatacaacattcacatcagagtgtcatagcaaaatctaaacgtggtaggtcaccaataaatgcaactactatgccacaagctaataggaacaatgagaaggagaatattaaaaggggtaaaatctcggttgatttctccataaatccaattacgaagaaaccttggatctatgaagatttcaagatcaatgaactagtgtcctcaaaaaatcgaggaaggggatgcaagaaatccaataaagtagctcgttttcacgctcaagctggatcaccactgaaaagtaaacaaaacgttgtactaaacagtaccgggttactcgaaactgtcgacgaaactagtgtgtcagacaggtcaaaagttcccgaccttcagtttcctgacgattccttcgataatctacgtgttagatcaaaatctcctcctggatatggaaggcttaacttcccaaccacccaagaaagattggacgacaaagaggagtcgaggaaattgctttatcagaaaacaaaaacacggtttctcgaagctacgaataatttagtgcctatatctgaaagagaattttacttcaggaactccaaattgaatgacatcgttgacgatggcaatttcacttggaatgaaaacgaattgaagatattcaccagataaaaggacgtattagctagatctataacgaccatttaatattttaatgaacaatttatgtcatttcgtctaaaatcacgtgctgcgaaaaacacgttaaatgattcatgttccaaaaacatcaacaaactgaatttcatcaaagagccttacacatttcggacacctactatttcttgaagttcaacgaaacggatggatgcagaaactccctgtaattctgtaattctttgctctatctctgtgggtgctgctaaatttgcaggctataattaggataaagtaattaggttctgggtagagagaaataacattggtataggtttccatcagctttttattacaactgtccctatgagtaaagatgtatttccattgttggaactcagtgaacttgtaacatgtctccaaagttgtgacttctcccttgctgtagaggaaaatatatccaaaccaagttcacagtatgtgattacactttacaagcaaatcattgatactttcatgggggtatcgccagatactttactttcaaatgaagccctatttgataattcaggttctaatgatattcagcagaatccagcatatactgaaacggtgaaggttttggcacttaacaaaatatgttttaagtttttccaagatataggagtatcagattttaatatgatggatctatacaagccagattctctaagaacaaggaggctgttatccgctgtggtgaattatgctagattcagagaagaacggatgtttgactgtgataagtttatgtccaagaccgaattcttattgaaccagcttcgttcaaaattcgatgattataactatcttcagcaacagatcaacaaacatagaaacgaaatagagttgagagaaggtgaaacttttgaaactttacagcaacaaaataaacatcttgatcaacagatttcaaggctaaaaggattgcaggaaactttgaatatagattataacgcctacaagtccagaaaacaatcgttattgcatgatttggaaaaatttggattcgagctcatagaacttgaatttgaaaggaataaattagagaaacattctaagacagacttcaatgaactcaatttgaatattgaaaagctttctacgcttcttgctactcagcaaacgaatttgaataatttggaacagaaacatagaaagcttcgaatatctatgaatactttccagaccttgacacatgaattgtacgatgttctacagttaatatcgacagacttgcaagaatctcatttgagggaagcaaatctcatcgatatgcgtgaacagctcttgcaaacagatcaaaaactaaacaatatactatcttccggagttatggtgaagatgaagattcttcagtctcagcttgacaatcaaaagaaaaaattacatcagttagaaggagaaacaaaggcaaaacaaatcgaaaattcggaaacactacaattattgcagaggcaatacacagatgaagtggttcctgacctacgggcagccgaggagcaggttgagaatgatttggccaatggcacaattaagaattatgattacgaaatatcacagctaaagcaggcgtttcaaacggaaatcgacgctatcgatcttgagtactcgctcttatcctcgcacattaatagatacatggaagagatgctacgtgttatggtagaggttacttcttagctggtagcgtgcctctcttatagatacacatttatcatttatacaaacccacatatttagatatcagttatgacggaaaaataactgaacgtaaaaatcaccattatcttgatcccaataagtacattttctgttcaactcatctagtgcaagggagtccgaagggtcataatcattaagttctatctcatcgctgggtatttgtattccgacattttcaaacggttcaaaggcgaccactagatatttaacgtttttaggatctggtttatcaagttcaaaatctgaaactatcctaaggtaaggaatgaattcatccttctctgccgaatgtatctgctgctctttaccatatctgacctttacggctattccaaataattccttctctgggtgtctgacttttacgacctttacttcaggttttataccattcttctgtagagaagctctgaagttgtcgacctcatgttggaagtttcggtctcgtactttgtccgtattgctctttaattgtccattacgtcctcctcttttcaaaacattaagttgatgttttttaccggttagatgtctttctacgctggaccatgaaacgtgcaatgtattacagagtttgcataccaatcttcctgagtggtttttgtaaatgtctgggttggctcgcaatttggacccttcctggtcttgctgaaaagagaacggtatatcctgcccattactgagtaagtcctgcacctgttttcttctctgtaaattttgttgtgaatcagaagcaataccaccactacctttcttagaacctgctctattctgataatccatcgtcaagtatcctcagtttctcctttgctctttttatgctttcgatatactttattatgggatgagatgagaagctgattagttcggttttcatttccgtgttttcttatttactttttgaatgtttgacatgtaaatttctgaagtgtgatgagcagcagatgtaaaatgctccgacattgcagaagagcagtcctgacatcttgaaggcttaacatgaattagtatagcattatgacggatgaggttatttacatgagttactttgttatataacgatttttgcactatataacaagagagtcaagctgcaacagtattttcgggtttttttgtgatttgcaagttggcttgcaccacatcatagatagaccattttccctagttcattgtatctaatcttacgatcttttctgttatcacggttaccactaccgtaacggaaaccgacttttcctactggtttttgcacgaattttagcttagatctttcgccatctaagagttctccgtaaaccaccttctttttgtttttgtgagtgacaaatttatcatggccaatagcatgttctccttcagtggacaacttctctagagtaacagcagctggctctaattcaagaactttagccgcgtcaattggaccgaatggttgcgattcagcaatagtcaaaaacctcgatgaaagggccttagatgggataggaatttctgataaattctcattgttagccggcttgaacacagggaacatcttgaacatagtgtcagccataatcttttgttgtggtttcacacggttctgggtataacaactcatatggaaaaatgttagtaaaactaaagcttatcttaaaagcatcaaaagtagtcatcagggtcatttcactggaagttagaactcagtgtggaagagtctgtatcaattcgtatattattttcagagatagtaaacaaaatttttaaccatttttatcgtgtcttaaagactaatcgaatttttatgttggtctcatcattatgaataataaatcaaattggtactatcagctgagtcaacattatccgttggaatttcccttatttcctttttttggtgtctttggtattcttaccgggattcaaaattctatcatatacatacatgcaactccaatttcttttctaactcaaccaatttaacgatggcttcgattcttggaaccttcaatccgtaagctctggacacctcttgtgctgacattttctcaatctgcaccttttcgtatatttctaaccttgtattctcatctataataaggttagtgcggcagtggtcgttctgtgggaatggtttcaaaaggcgatctcctcttgcagaaaaaggacttcttcctgaagccggtatcacgttcttatcgttcgtatatttcaaagtagtaccactcactggatctcttagagcctgaccacgctctaaatctggagtaacgtactttggctcatggttctgaggtgatgcatagtatctgttgtaaatgtattcacctttgaaattctttggacccaagaattgtctcatggcaaactttaagttagagtcatgtctaattttcctgttcttgttgttcaacaactcaaaaggatatggtggatatgcgattgtcctccttgagacatatctcacttgttgaagtggaaattgggcaccatttcttcccagcattgtgtctgatttggataaaaccttggtaaggtaacttattcgctatgttcccggaatggtaggcctggttagatgtgcagtagctaattgatactaatctataggtgctttaaaacagaaagcagtttcagagtaggtatttccaatcccaaacatatatcgtttctcattaacgttgacaagtgaaagcttgaaagataaaaaattttcggacacagttacccgggaacgaatgttaaagtcatgtgacacaaattttgtgttcacgtgactcgttcagattaatctaggccacttggaaactaatcctcgaagttcaatgatagcctactagcacgttttaattaccttttaccgctgtaaacaccatttgtttatggcaccgagtattatctctttaactgatatcctgggcggttattggcgtttgtttttctgttttcaaaacacgtaaatatccaataaaaacgactatttaatatagactggtttcaaagatggatacgaaccacattcaagtccatgaccaacaacaggtgaaagcagtcatttgcagtacatcgaatactgttcaaggtaccgtgagaggtgtttcctgattttacttggtgctttacttccatattttttactctgatttaaagagaagggagacatggatagatccagattgtacaacaaaagtattcgcgaagcgtatgaaaatatggtgaagggagccggagctccgcacttaagcgctgatcatgataattccaaggttagcagatattctgcaagtataattcatgaggataatcggcgagaaggattggaaaatagtgagttttcagacaacgagtcattgaatgaatatgatgatgaaggggaagaaaatgatgcggatgacgatggtgaagcagagaacgattatacacaatttaagaagtcattaattcaagatgatgagtggcttgatgatgaatcggatacggactatacagaagaggccgatcagagctttttactggagaaggacaatgataatgatagtgacgatgaaagtcgtcgctacgtgtgcccaggttctgaattttattttgaggattctaaaacaagtaaatccggtaaatggtattttcacaaattctggtggcttatcataggtctggtatgtgtatggtttttggagtcttatttttctgtccatggttcatctcccttgaccccagatttgaataagaaaattaatctactacaaaatcagttgaatcaattgaaccacgaaagagatttacaaaagagcaaatatcaaagcgatttggatcaaaacataaagttaattattcaacagttcgagaaaaatgtaaagagaatattaccaaagaacataaaggatttttcactacttcattcaacaattgagaaattagagagtaaagtagatacgttaggtgaaaaagttgcatggaataatgtcaacgagacattgtcaagattaagcgaaattcttccatctgaaataccagttataatagagtcagatcattcgtcgtcggaaactaattctacaaagcaacaggttttacttattcctgagttgcatcgctacttggttgaactaataccgccgttaataaacaattcgtttgatgcacaatcaatattgaagaactctgacttcaaatatgacctaaatcattatgttaaggaaattctgaataatgagtttcaatacattgagagatcacagttcattcaagagttacagtctcatattcaggcaataaaagaggatttatcaagagaaattgaatctaaaacaagccaattacaaacaccacaacaactctcgacagtggtcctaaaaaaaatgattcatcggatctataactcgaatcagcatcaactggaagctaatttgaataaagcgactttcgctcaaggcgctaaaatcctaaaccatctatgttcgaagactgttaaaggaaccacaagtccagttgatctactacaagattgttcattcggatgttctagttccacttattggttaggtgatagcaaagggtgccaatgggcaattcgttttgacgaaccgatattcttaaccaaaatatcatatttacatggaagattttcccataacttggaggtcatggcgggtacacctaaaaaaataacaatttatgttaagccgttagtgccaatatcaaaagttgaaaacattcgtaggtggcctgtcgactcaacttacgttgaattaggacagttccactacgatttatactcaaacgctatcaagcaagatttcttattgccagactggtttattcaatcaaaagctctaataagatcaatggttttcgtggttgacgaaaatcatggcaactcatcctacactgccatgagaaagtttattgtgaatggcgttactcctaaagacttacagctaatgagctcgttcccttcggactgggctcaaatgactcctgagtattcgatatctctcgaggaacaggaacgagcacgactttccagagttgcacaatggcaagatcagcaagtgccatctttcggagaagatgaacttgttgactaagaagtaaagtattgtgaacttctaggatcataacatagggctatgtctgcagcaatggcttcgcatcttgcatttctcttgccacatagccaacatttacgggattgtctagggaattatctcaatgatgtcatctaagaacctaccatgatcacaagtccactgcccctctgaggaagcaggtgttctacattgattataaaatggaaaatgtttcagagtcatcgttaaggcgttacacttgtaagtatattctactacactcggttatatccatccattgccattgcctacaacagctttcatttcagcagtgcacaatcggctatttgagctgagccttttttttttgttgacgttttaggggaaggcattatattttttgcaaaaaaagaagtgtgagtttacatttatccagtactaataaaagaagtgaaaatatagagaattcgctctatcagtcttttaagtaagtgagtcttgtaagaactcatctttgcttcaaccttaaaactgcgagcagtaagagtttttatcaaggagttacaatggtgggcttaaagttgaaaagcgctttccaattcaagaagaaaacggatgccaaggataactcttcatcgggtaaaataagcaagctagcgtctattggaaacgacctttacccacaggactatgaagcattgcaaccccttttaactttgttgaatgtccaggctagtaagtgctatgcattcgagaacgtgtctggcgctttcgtggcaaaatttggggacaaaggtttcatacctgtaagcaagttttccttgatgggtatgaaccttactctatacatcggttcgatagatacgcacgttgcggacgaggaagttgttgatattgatctcaaaatgctatgggaccacaaagttataaaagaaggtgagaattatcatctctccttcgagccaaactgtgatatatctttagtatcttctaatttggaagatgtgaaacagttgagtaaagcgatttcgttggtgcaatttgaatatggctcattgtttaaagcgctgacggcttcaattatctctctaatgggactcaaaatttccgacattcacctaattcttaacaacaattttagttataaagactggtgctatatcaatattaacaatgaatggatcaagacgtggtgccacatagataaaagaaacaaagccaccgatgcaaagggtaagtcaaaggtaaagttctaccgtgatgataagtctacttctaaaaagaacttgatctgtttcatttctgatgtagacgttgttgaagatatattcatatctacagagcctatgaattcttcgaaatctcacacgggagtttggaatttggacgagttgagaactctaatgcatagtggtttgaactcagctgatgctttagacaccttcatggaaaagttggataccgtttctgtaataggttcggttaattggatcaatcccgactcattgtctgatagcccgcgttcttcaagatctcgttcttcctcatttgcatggacccctaagagtcctagaaagagagtcttgagtgtctctgattcgaaaagtccatcccagctaagagaaaactccgtatcgaatttgactcaatttgttggtggtaccggcagaaatcactctagaaacatgtcatcagtctcaacaaattcctcgacagccatcgatctcgacgaagccactggtgaggttaccacccaaaggttcctattcaaaccaattcctcatgcaggcgttcaccatttagaatcaataattaggtttttgattcccgtctacgattgtctacagttgtatggcaggcccactgccttcagaagtgcacgtgaggatgtaaactctctctcatttggccttccaaaactacctgctatagactatttttcggaacaagaattacaaatgatattttccaaaacagagtatgaagcggacagcatcagtaggtgggcttacttcaagacgttactccatgaatgttataagaaccgatctcaaaattcggatgagtctttcagaactttagcagacccatggaacatgcccaatgtcaagatcccactatcttccgtgacagcagagttccactactctacaaatctcaacaagtcaaacgactcacctccaatcgtatagatgtattttattcttctcatgctttcactccttgtcttatatccttgttgcatacaaccaatattttccccaagcttataaaaatgtgtataataatataatacctaggaaaccagtgtacttgttttagaaacgttccagctcggtagtgtattagtaaattgatgattatcatgtagttcaaccttttggtacacggtatcgaccagtcagacataccaataaattcaatcacgtggtttaatatcacaatacacgacaaccttatattttttcgccaccatcaacgattttagttttgatattgtatggattatggatcaagaagtatcatcaacaccgtcttagacagaatgtcagctttgtttcaacgattgaagtaagattgaagtaagataggaggctcttttggtggttcagcttttattcaattgatcagcaaagaaaccaatcagcgaatatgcaggctccagttgtgttcatgaacacatctcaagagagaactacaggacgtgaggcgcaaatcgctaatattacggcagccaaagctgttgctgatgttatccgtacatgtcttggtcctaaagccatgttgaagatgttgcttgatcctatgggaggtttagttttgaccaacgatggacatgctatattacgtgaaattgatgtggcacatccagctgctaaatctatgttggagttgtccagaactcaagacgaagaagttggtgatggtactaccactgttatcattcttgcaggtgagattttggctcagtgtgctccgtacattatcgaaaaaaatattcatcctgttgttattatccaagctttgaaacgtgcactatcagatgctttagaaatcattcagcaagttagcaagccagtcgatgttgagaacgatgttgccatgaagaaattgatccaagctgccattggaaccaaatatgttaaccactggtctgaaaagatgtgtgaattggcattgaatgcggtcaagaccgtgagaatcgatttgggtactacttcagcaggcgaaactaattatgagattgatatcaagagatacgttcgtattgaaaaaattccaggtggtgatgtactagattcgaaggttttgaaaggtgtgatgctaaataaagatgtggtgcatccaaaaatgtctcgtttaatagaaaatcctcgcgtcttgttactagattgtccattggaatacaagaaaggtgaatctcaaactaatattgaaattacaaacgaagatgactggaatagaatcctacagatcgaagaagaacaggtccgtttaatgtgtgaacaaatccttacagtaaaaccaaacgttgtcataactgaaaagggtgtgtctgatttggcacagcattatcttttgaaaggtggatgtagtgttttgagaagagtgaagaaatcggacaataacagaattgcaagggtcactggtgcaactattgttaaccgtgttgaggacttgaaagaaagtgatgtcggtaatgacgctggtgtctttagagttgaattaattggtgatgaatatttcactttcctagatgattgcaaaaatccaaaggcgtgcactattatgcttagaggagcttccaaggacatcttgaacgaaattgacagaaacttacaagatgctatggcagttgcacgtaatgttatgctatctccttcattgtcgccaggtggtggtgcgactgaaatggccttgtctgtcaagttaacggaaaaagctaaacaactagagggtattcaacaatggccatatcaagctgtagcagatgctatggaatgtattcctcgtactttgattcaaaacgccggtggaaatccgattagagttttgtcacaactaagagccaaacacgcccaaggggacttcacatatggtgtggatggtgacaatggtaagatagtggatatggtagaatacggcatctgggaaccagaagttatcaaacagcaaagtattaaaacagctatcgagagtgcatgtctattattgagggtagacgatattgttagtggtgtgagaaaacaagaataatctatcttctaccaaaaggtcattcatactaatacataacagatattacttgtacaatatttaaaacaatttcgtttaataatctcacactgggtaggcgtaataagtatatacaaatttcgaatcattttctcaaatgctcgagatccgcttcaagactaaggacgacatttctgagcttcaatgccgattctctttcaaggtacgattccatacgctccctataatggcgaagttttgaaacaagtgtgctgtcatgtgctccactatttattaataaatcaaaaagtggattccaaatatcctgctgccagtaacgtttcaaagggcttttcaactggtatctgttggacgctacttttactgtttcgatgtaatgtccgaatagcatgcaaaatatcaccccagcaagcccataataatcagcttcgtagctccatggacgttgctctctcatttcagggcaatcctgttggtcagtcttccagttagatctgaatttggttcccagtgggaataatgaaagatcgaaagatcttccaaaatcaatgagataaattccctttctattccatccattttctccatttgcaaaatacttacccaaatgagacactttctgaaatctgatcatgcaattatctggcttaatatcgccgtggataattcccacatcgtgaatacattctaaaactctcatcaactctacagttatgaacatgcagaggcactcatctaatgcacctccatttctctcgcgttcccaattaactagatctaaaattgttccctggttagcataatttaacacaagatagctttcgtcctggaagcaatgcaatgcacttacatttattatggattttagtattgcttcgtctggcactcttctttctatctgttttagtatatagaattcccatacacttgccggtttttctaccttcaaagcacttaattggcctgtgctagattctgcgagatatactgttgcatatcctccttctccaagttcccttctgatacaatacaaatcgttggttttcttgaaatcgactatcggatttttgttcatattttttgacactttctgaatccgcttcaataaagagctcattttcaactgttgcgaatattcataatatgttgggtatgatgctaaagctggatccaacgattccaataactctcttcttagctccaaacttaatggattctcaacaatctggtgtgaaggtgaggggtcaagtaatcgctgaggttgtgtaagaaaaggcgaagattccgccgtattaactgaatttgtactcttccttctagattcaccagtgatatcgtcatcttgcgacagtagggtcttgaaattgggttcagttctttcctgaattggtgtcatataatcctgtagtttacttttgaaagtgggggtagtagtttcttgcttttgatctctggaaggtgttgcattggcactggtactggcacttaagtttttactttccatcggctgtttgacttctgttaagtcttcagagtttttacctgttagatcttcttgaaagttttcatacatggtgaacttaccactagttgtatcgtcatggtcagagtaatttttcatgtcatgataactttgattgaacattgaatatacttcattcatggcatctttggagaacatagttactgtcggagactttgacttaccatcagaatgtccggttaaaccatctggttcaatgtctccttttaaaggaaggattgaagttgtagttaccttatgatactcgggagattttggttgcagacctcttttcttcatgggtttggaattctcgtgattattttcttccaaatgtcgtttgacactggaatttttttccttatagtagcagtttcttgctagtgccaaaacttcttcaatacaatactcctcatccgctgtagggtatagtaattcaaaatttgtttgtattttttctggcttccgaccaggaacttctatcagtttataaaccggcgtagcccgtccgagatcatctctgaatactggtattttatccaaatctgtttgcgaaaagctgttagattgtttcaatggcgctatcgtagatcctgatttaaaaggtatggccggcgtatgattctctttatttcgggttttatatggtggcaaggtagggaggtcctgcctcaacataaatttatcattttgcagttcttcttcattatcagcaaatacttgcaattttccagtggatttcaacgagttctgcgatctttcagacatgctattatcattattgcggctaatagaattattgcgagtatcatttatctcacttctatatcttccaaggacaagatcaccatggatttcgaatgttgaaaagcttcgcggtagttcctgctccgttagaccacgagtttgtattgcttgttggacacttagtttgaattgttcaagtcgccgcagtggccttgcttttttttctatccctcggtcaatcaaatctagtgcgtctccggatgcatccatattgatcaacaactgggagaaactttcgtaatacaatgctaatctatctccgatttcaagtctcatcatgtagacgaacatttctcttttttcatccaatttgacggcaaatagatcaatatactgtaaccacaacttcaagtatcgtacatcgtttttgtacgtttcaatattcttgcagtactctatacatctttccattatctctggtaagccagattgtcttgtggtgggagaaggatagttatcgtgaatccagttgatatactctaaaaacaattgcaatggatcatcaagttcatccaatgtatcatggatatcacgttcgaaggcgagccttgtatcatatatagaactcagagatttgttcatagcagaagtgacgcgtgtcgcagatcgtccttgaggtagcgatattatattctctttctgtgcctccaattcatcgaaatggattggacccattatcctccttccagaaatctggcacctatttatcagtgtcagtaagtctgcagttccttcacgcaacaaaatcacacttcacaggccttaatcgataatccatgcaggtcccagcttgaccatttgtttgtttgaattttggtctttgttgatatgacaaaaactcacagttgaaaatgtaaacactacgaattctttgacacttagaagattgaagaaataaagaagtggaggggaaagatggcaatattatggtgcaaagtgttatttaaggtctggcagtcatgcaaaccgttcactgaagagtgaattgtcttactgctcctttatattaaaatgattaaagtcaaattttagggtactaattaacagttatggaaaaatactaaatgagtctatatggtgtcagatgcgcacgttattcatacaagattgcagaagaaggtaaacaagatggaggccatcaagaatgcacagatcatacgaggaccgtacttatcctcgtaatcgatggagcgcttcattctgatattgacaacacgtttacagtacgtgtaggtactaaaccagatggtgaagagtgcagtcaagaagaaaccagtagaggcgaccattgtggttggcgtaccataagttaagaaacttgtggacacaccgcccaaaacaagtccgatagatatccatgaaagtaaagttctttcagtggcaaaatacacttttggttccacacgcaccggcacacatatggttttccccggtggggcatggacgtatgtatcaaagacagtaccttcgggaaccttagaaacttggtcgccgtagaggtagtgatctatttggtacactaatgtgtgccaatatttggccactggattagaagcttgtctgatattgcgcagaagagctgcggaattttcactagcggctggagaatccgctgtgttcccagcgcgagctgaatcttgagttatagaaccatagttcccagtagaggattgtccagcaggtgcggtaccggcttctccagctgcttcttcgatatcgtaggagttccctggagcagccaactcttcatcttcagtgtcctcatattcgtcttcatcatctcttccaggtcttgtgatattgatgtgagttgggatggcgggtttcctgatatcaacatccatttgaggtagccaaaatggaatagaactgactctgtcgttgagaagtgacgcgacaccgtgaatgaatttagaaaacttaggcacaggttcaactaaatgcgagcccactaattctctgacccattctggaggctcttgacccatttgagtttgtagtttgacttccaaaacagcgtaagggaatctacaaatgtctttttcaggcaactgattgaatggccaatctacaccaatatccattcttctccagttaccgttggttctgtcatgaccatcaaagttatcctcccttaccatggacaattcagtatctaaagaaatacgcacgcgggcatcaccaggcaattggaaagcagttctgttatagaaacttctggccactggtcttagtttcttcttgagcattgtatactgtgtttctgtagccaacgcctctagattctcaatttcttggattgatttcttcccctctctacgcatcttggcgaacgcttgttctacagtatacttcccatgcaagaaatcattaacgtacttttccttcaatgcgaaacgagctttgaccgatttttcaccagtccaatcttctctatgtgtctttcgttcgacgaaaattgtgtcagagctcataccaccgtaccatctcaatctatgcgcctcagcaccttcatccttcctcaaacgaccgtagtatagatcaaggtcctcgttatcgtaataaatagaggtaatggcactgtcttctttttcaaactctttgttagtgttgaaaacaagaaccggcaaatgctttaggatgatcaatttcaactctgtaatattatctggatgaacccaatactttgtagtttgtctaacgaaattttgttgtttcccaccagcagcagaatcaccctttacaggattacccctggttctaacgatatcgtaaagttgtgaaagtttcaccaccaattcatcgtaattttctttaaagaacggtttggcatccattctgacttggaaaataggtttcaagatgaaattggtattcttatcatgcttcttaataattttttgcaaaccggtgtagtttaacctggcaaacttggccaaatcatgcacatcagcaatgatatcagacaattcttcttctaagatttggaaatccaaatctgtaaccggaacatttgtatccaaagaacgcacagcgacagaaacttgttcctgggcttgcttgatacgacgcactacctcgttatgcttcactttgcaaaaagtgtacactttatccaattcaatttccaaggactccaaaaactgagtctccaaatcctcgttccattttccgttgttagcttccaaggattcctgtaactccgtcttcaagtcattgtaactgatatagtaataactgtactcacgaatcaaagatcgcttcaaatgttcaccaaattttaccatcgttatcagtatcagctatttcaaaggtcctgatgcaagtctaacccactcagaagccctgataactactttattctagggtatcccttttttcccttatactgtcacttggaaacattgaaactcatgttcctgatcttttttctcattgtatttcggtctgttatatgtgatttttttctccaagcatttaaacattatagatattgtattatggtgtataataattagaggcacgtgcgggagatgcattcgagaagcgaggtcacctgaccttcgtcaagtcttgattcgcactcttcgactatgctatacaaatggaccaagtttgttggtaattggttcactatttgtagtttttctgctttgtatagtgggaaagcatttaattcttgcattagtgttgagaattggtctgtagttaggttcagcagtgtggatttgttggcgttattgggtacggtcttgtccgacgtttctggttcttctgggtcttctgctgtagtggaacgctgtgttatgtaccttaccgtgtctctggttatcgtttgcagttctggatggtagtatggtttgttgtgtttcctgtctgattttgatccagaggtccatcggtgttgattctgtaatgatatgaggaactgcaaagtttcgtagtcgctcataaaagcgtttttttcctcaagcacgcgcattttcttggaattttgttatatgagaagctttttacttggataattcagtataggccgatacagtctttattacttgctactctttgatctcaactcagctcatctcttctctttgcatggctttcaatatattcgaagcggtgaaaaataatcccgtgtatcatgatttagatgaacgaaacaagtgctcagggtatacgtatcctgctttgtgcataccagttgcatggctgatgctggtaccatagcgattaagatgcacctattaaaattcaacgaggttagtttatattacaaaatgactatttattagagaagtagaagtgctggaatgatagcaagcaattgcggtaaattgaaagcagcagcgttttctgactgtgtggatgttaaagcagctgatgagcttgtctcgccagtggcatacgatgtgatctcttcgtcagcagcggtggtagtgaccaaagatgagaaacctgtggtcacaagttcttccgtggaagttattagagattcagttgtattcaactgagttgaagaagatgatagggaagtggaggaagatgttgtgttcaatgcagtaatactggatgatgaagcactggtagatgaagcactagttgtgttcaaggtgctttcagtggaagtagttggaattgtggtactagatttagaagtcgtagtgggggaggatgaggataaggatgaggatgatgatgatgcggatgaggatgaggatgaagatgaggatgaggaagtggatgaagatttggatgtagatggagatgcacttgtcttggttgaagatgaagatgtggaggatgaggaggatgaagatgaagtgtcgtctgatacgcttccaccagaagctaacttatcgaaatctgctactccttgatcatatctaccatacacctcaccatcattagcttcaatagattcccaagtaccatcggtgcctgagtatgagtattctgtaccagtggagtaatcaacaacgataacgtctttcaaatacatgctgaatggagctttggtataatcggtcaaaccacctgcccattcaatggttccgggctcgttttgggaatcaccaccagcccaaatacctgtgaaaatacgcattggagactctgggtatccttgaccattgtcactggtgatagtccttaccagtgcactgtcgacatagatattgatttcatccttagtccaatcaatggtataattgtggtaagaaccttgaggatcgtccaccgaatggaaagcaccacggtcaaatgtagtagtttcacccttggagaagaaattggattgaacttgagtagtatcagtaccagtccattcgatatcaatttcatcaagatcatcactttgcaaatagaatgaggaaataataccttgaccaccggcagccttggcaatcgcttgaactttaccaaacataatataaaattctgaaaccaaacttggattatccaatctcttattaatagtcatttcaacaccatcatcaccataagaaacattaccgttcgtggcatatctttcaaaatatgaagattcctcatcaaatggtacagagatggatttacccaaagcaggatctggtgaacatgtgctggcagtcaaaggattacatgctgttgattgagcgtaggcaactgacgccccaaggcccaatgcactcaaggtataggttaacttcattttcgtctgctgttacctttgggatgtgattcttgccaaattgatttgttccaagatgacgcacgtaaaaagaatgtctaaccccaatcaatattgtaatactagctcttttatatatacaagaggtgttcgcgtatttcaagttggtttcacgttgatgcccagggttcaatccgatgtatttgaacgggaaaatgaaggtcaaaaacatttgaaccaaccaaatcccacagaaacatatgtaccggtgggaaactttgaaaatttcccactatttgaatgcgctaccaaaaataaattgactgaaaaaattcgtggctttgatgcaagtctgtctgttcatcttcatgatcaccggcaacttctccatttactatatacctgccatattatttttcgttgttcttggcttgtactgtcactttggtggctttttcctactctttttgggttttctaacctttactttacccgttcgaggaataaaattagaaaaactgatgaaaaatttcgagaagacacagtacagttcctagagaatgagaaatcgtgctggttttgatgcttggttttgcaattaagaatagaaatagaaccagaaatagaaatcaacatggaagttgaaaagtgtgtcacacaaatgagctcgcatgtgtgttggtgggagggagcagcactaggtgatatatgccgtagtttttactaggtgtagtaattctgtttcaatgctgcatagaaaagaaaatatcaattctaaaaatagttcaaaattgaaattaaaaataatggttgcgaagagattcgaactcttgcatcttacgatacctgagtgttcccaactgtaaggttggttaagataggtatcttgaatcaggcgccttagaccgctcggccacacaaccaatttcgtgatagttgttatattcctctatagtatactgaaaactcaagtcatgtgcaacgtgctttaacacccagacgactactgattattttatttattggccgatagtggtgctaaaatttctatgtccacccaagcgaggcggaggcccaggtttttacttgtatgttgagaatactaaaaaaaacaatagaatcgatcttccaaatatcgttctcatttgatttcgcccaggatcgaactggggacgttctgcgtgttaagcagatgccataaccgactagaccacgaaaccgttgaaaagtttgtttgtaagataaattcaattgtaactgccacctccaggaatcgaacctgggtttcatcggccacaacgatgtgtaataacccctatactaagatggcatagtactttgcgatgtttgaatgtggaactgccctgcaccaaagtgtctgactaccctcacacatggtattcagcggcgttttctcagggcatctcctcttcctttctccctgataatattcatagacacacacacaatatcaaaccccttagatgccttcacattgctagtacttaatcataccctatcattctatcgtattaaacctgttcacacttcctaacaaaagtaccagaacttacatcgggttcattgttactttccgacggtgtgcataatttggctacgacttttattttgcatacatctacgcaccaatttgcagcaaaaagctatatgaagaaagatcaggcaggggaaagaaagcgcatcgcattctgtggcgtgggtatataataaataaataactggatcgtttttggtgaaatagatctatctcagacaagccaacattgttccgaagtattgaccaaagcagaatatatagtgattcaagagattgctacgaactatagaaggggttttaactagaaagaaagtaatgacgctaataaagatgtttgcagctagacaagccataggaagatttgcattgatacagaacagaaactttcatgctacgccgatgagatgttataaaaaatggaatgaactaaagaaggatgataagcaggagttcatcaagaatttcgttcttttgtacaaagaaaagcatccatgcagtaagagtaacgtaatgtacagggcgttggccagtgaaatggatgaatacgatgataccccatacgtatttggtgttttgtacaatgagattagggctgttgaaaaaggcgaatctactgataacgagaaaggtgtaggtgcgatgggggatgcagattttgtaaaactattgtacaagtagaattgttgagtttccgtacataaagaaagaaaggataatatattgtacatattcacaatttaatttaaatttctattcatctcggtcagtatcacgtcaattgcttgaatgcatgcattctcaactcaataccctatcaaggtcatcatttgattcaattgcatccatggcctccacaacatgtataacttcatctttactagtttctattatagatccgtcacacattatcatttcatccaatatgctgtatgccttgctaaaattgaatatgatatctaactcgcagacgttcccaaaatatctatccatagtttccacaaatctgtgtataatttctaaagtcaacaattcgttgtccgaatccaaatcaatccctgcaatgaagtataaactggcatatttcttgtacacgactttgtgatcttgatattctagaatattgcacatttttgacttcctggacagtacgttagtcgtcacttcccttagtattttatgcttgtactttatatcgaagggttgataccatctgattaacctagtcttgccttgcctcgacgtgagaagcatgtacttaatctgtgacatttcaatgaccttttttgtttataacgaataggatagcttttgtctcttaagctcggtggttgtggtatttaatgcccttgttaatcgtttatccgtagtttctcggatacaccaattgaaaagttgtagagctgaataataaccttaattttaaaacatcaactgggacagaattagacttaaactttgattctagtgacctgttattctttgtttgttttcttttgcttacatgctgattcattcgattcagttacgttattacattcatgttatattaatagttaatataacgaaaaatgagaatcaccgcagacgactttgcatgaagctgaagaagcggatacacaaaggatacatgcaatatataatttacatatccatgacctggcctaatcttcatcttctggaggtggaacccatgctggtggtttgaaatattcttgatcactggcgacatcttgcttgaatttttctctatcgtcacagaattcgagcaaatactcgatttccaattcatgggtttgcctaccgagtataactaaagaatgcaatggttcaccagaatcatattcggctagctctttgatggtacctgctttgaaggtttggcttgcagaacctagtcttgagattgctacacagggagtatcaggagtatatgcctcagtgcctcttgtttcttcaatttccaatagttgttcacaacattgtgcaatactcatgtatcttggaggctcataaatgagtcttccacgagccatattctctatactctgttccttcactttgatatctagaagaaccaaggtgtgcaacccgattttccggttttcccatatcttgtcgtaccaggaatctggtctccaactatcggtgaaaaagaccatagagatcgtttgaccaaaattgtatagttgcaacccacatgatcctactgcattcataacagacgcgttatggatgacttctactggaatattcctttgcttggcacgcaacaccaagtcagtatgagtggtggctccaaaaacgtcaccgacaaccaaaaacgcaacatcttctttatcggcatcacggagaagttcttcagctcccgattcgacaagttccctgtcagctagtgtaactttcttgccataaaattcctctagttcttctagagaagctgtcatcaatatggaagtgtagtgctccaagtacactctcgaacattgcttgatggcattcaagcctctgacggtgatatctgtttcgtaagaaagacctaatccaataaagtacaacatagctaccaaaactaccctcgttacttaaaacttcctcagttacaatttgaagcagagaccaagctaagtgcaattactccattccctcctgtcaaccatgcgatgagctagtcatctcgatccactttaattaaaattttcaacaattcgatacgttatgaagttgggacaaaaagagaaaatgaatggtatcagctcatatctaacaaaataattggatctttagattacaccacgatctctcctcttcagcacttataccagaactttgagtataccagacagtaagggcggtattcaggagacctttttaccaatcctgcgaaatgtcggaagatgcagagagacaacccttactccgagacgttaatcaaggattgaggagttccgagccctcgaaccgattccacaaatcgtccaggaatagagttactgcgggaattatagcattcattgtgctattaactactaccatatttctgggtcttatatatgttaaatctgtgcttccagatgatgtttcatttaaggagcatattggagatatcacaaatgttgaaatcaatgatatttcatttaacggatggacatacattgacgagaagcggtactacaaacttggagtaaaatcctcggtgtggttagattatgaagctggatcagccgtatcggaacgacaaaagaagcttatctcttttgccgggactaggattatgaaggaactgtgtttcgatttgaacagtttagacactttcaagcaagaaaacgacaccgacgtcgtttcattgggaaaaattattatacccaacactacatgtattaacattcagcaaaatagtaccactgacttggatctgttagtattagtgaagcccaacacagagcagttgattccaattttgaaacaaatttgggagaagaagtacgatggacttaacttatggagtagtatggatctgaagttgaaaaagagagttttctcacacgaaattgttttattgagtataaacaaagcaaagttgtattggagagatttcggtttatggaaaagtgtgattgatacacttaggcatctctcagccgaaatttatgacacaattgaaagaattgaaataaacaatataaacttgaaggaaatagaagatggatatgatatttcctgttctatcggagttccaaaccctctaagcagtacctgcaataaattaggccccggactcctaatatctcctggcatgcaatggcaaacaactttcccaggatgtcgtaatgaaaatgggattaagcttgataatgtagttgtgcacagccctgagttgacctcagagtcagtatccaaaccattcatcaatataaccttagatagtacactgataggtgagctaccaaacgaatttcttaatcatgtatgcgcatcagatgattctaacgttataacaccactgtcaaaattgatcaaacaactactcgatcccaaatacctcattaatttagaagttacttgcactgctgtggatagcaaaaattatccaaatactttacttgaagattatactgccttacttccatacctttttacaccgctttcggtaaactatacagttgatgtgaacaatatagtccaagaagtaggtactagaggtatcaagctacaatggtccactgatctacttggtcggaaaaggctgaatgtcaagggtaagattgtagctaaagttcaaataccgttttaccagttgaaacaagatacgacattctcgatgcaaagaattaaaggacgaacaaaattgtatcacaatgatgttcatatgctaactgtaccattggattcctggacgaaatgtatcagcaatgttgtgatcgatgaggataagcctgaaaaatcgtacttcgatgtctcatttgacatagataacgaccaagttattatagcagatactctagcactcactcattgcataaacgaagtagtgtttaaaggggaatcaacaatttttttgaaggggaaacttgatttgatggtcgcaacaagtattggagatattgttctattagctcttccaggtgagggctcagcagtcgttcgaccatagcacaattatatatcattttgccagttgttctacgaattgatggctatatttttattttattatatattctcgtgctagaaacgtacgtaccggaaagaaagtttatgattacatgagaaatcatacacgatgaccagtttcctgccgtgttcctgattacttttcatgcaagaataagaaagagacttggctatggttcgttgatcttcatttgtctgtctttctttatcttatcagtgattaaaaatgaaaaataaaaacaaaaagctcgaaaaagggaatcttgcatgtacttctccaagtattaaacagagtagtaagaagaaactggatattgagacaatgaagagctgttgttcctccaaaggattgagacctctgtttgggtattgaatgcacaaagcgtaacacgaacgctctccctaagtaaaaactggtaaggaaacacagaagacctgatggataagaagaacggtaaatcatgcttggtatgtagaaggcgcaaagtaaggtgtgatagagcaaaacctgtgtgcctggtctgtgtaaagcatggatcaaacatggaatgtaattatgaagtgcaaaaacgggaggtaaagtttgtttctatgaaaacgcccgatgtctccaaccctagaatgaagaaacagaaatcattcaagtattccatacctttctccggaagcacaacggtggtaaaggagctcgacgtattgaaacaaagaatacattcgttagaatcccttctgagcaaacgtaatgtttcatcgacaagtgataacatgaattattcaccatatgtgaaaattgaacgaaatgctcattttggcagcaacaatgtcgtacccttggatttgagcaattatgaggatttcaacttttaccataacttggaaacagttgatgtgaaaggcggccgtttatcattcaccggtgctttgaattacatttccatttcaaaagtggatccatatttaatgactataaccaccttggtacgaaaggcccataatgataggagtaaccaatttataaggcgggtacagaaccgcaagtattcaaatcttgaatatattccagcacttgcaaaagaagttttcgtggcgaacagaaatgaaactgatacggccgtaaatttattggttgaaatatacaacgatgagtgctcaactagcaacataacagaaaaagacgacagtgctaatgtaacagatgatgaaaacaatgatgtagaaggagtaagagacactgttaaagactctacttcggagtttgaggttggtaatcaagcacaaagagcaaaatttgctcgaaagtaccttgaagatgagaatttggatggcattttaacaaacgagaaaggatcaaacagaccttctctagcagaaattatcaatacaagtgctataattaagtcaaacgaagattccccaaagtcaagaacaagttctggatccaaaatctcaaaaaatcacaatggctactttgaggcaactcaatgcgataacaacgtaaggcaaacaagagagcagtcgctgactgataaaacacaatcgaaaagcgagaacacccctgcctctcttgacgaagaaacagaaattttgaactatataaggatgctactacctcccgcgaagctcatatggatacatctcgataattatttcagctctcctttacatgcattgtatccattctcaacggaggattggttcaaggatatgatagcgggaattctcggaggtcgttccgagtcagagaaacccccacctttgaaaatagaaaagaaattggactttgcaaagcttgcaacgtttttcgtcattatgcgcctatcctacttgatgttcccagcagatttagaacattgctctaccgaagaagaaaaatatgttgttagtcatgagattggaactgtttatattgatgtcgccaatttatgcatgcgtatgtttaacctttggagaagaggtgtgttgccagtccttcattgtttgctattgttgagagtgtatcgcagatatgcacctgaagagggagatattgcggatggtgctgactctagcacatttacaggttcattagttcagattgctcaatctcttggaataaatacagatgctgaagcatcgtaccagctaaccaattttgagatttatttacattcttggagaaaggcctggtacactatatatttcatggatgtttctgaggcaatgaatatggggaattgcttcactattgacgtagaccaattcaacaccaaacttcctcatatcaaacgagaagaagatgggagcatcccggaatttttcctaaatcctacccatgaggtggccagtgttgactgctataggaaaaactttgaattttctttacatgtgaggaaacttttaaaggttgtcatgaacaaaagaaacagatccccttgcaataccataatggatagaattgcaaaagtggagaataacttgaagataaactattccgaggatttgtcatatatgatttcttcgggcgtggaaggttcacagctatgcattgaaaaatgcaataactttcgcatgtatgtgaatacacaatcgatgttgcttataataaagctacgactgttcattcatctggatagtcatcatgctgaactaaaggtgaataatttccacgaacctttccaattgctcaaaatgtgtctttctctttacgtcgagcttgagccgctgttgattcttttgcattttcacaatcaaaatgatgagaatgatatttcctacattgaaaagatctttggaccgaaatctaagataataatattacaggcatgtaatcacatatttgttaggtgccaaaccgtattgcatatattgctttccagacttattcatctttaccatggatatctcaaaaacccggatcctgtatatggaagttctaagcacttctttcaaataaaagaactagtgaccaaaattatagaaaatgctttggataaattacatttcgccaatagtgtaacgcaatctttgagtggaagacaatttcaagcttggagactctccaagggtaatcgattcctctactcacttttcaaagatgaaaagaataatatattcgatccacactcccctataaacaccgcgttccaaaatttgggcatacaaagagataacttgggcgttccattattaattgataatttaaatccagccaagaaattgccaaagtataataacttcttgctgctggatctttcacagtttgaagaactctattctatcatgaactctactagatggtctatcttctctggcatattcaatgaagacaaactaaaagaagctttgaactttcgcattagcgagcacaaacaatcaatctcgaccaaaacagaaaaacggagaaaacggagtagctcaacgtcaaaccccacgccggctccaccatgtaaagaggttctagattcagtgagtttatctagtaagtcatcagacggtaatgatgggactgggctcaacttgccccagttgaaagtcaatgaggttgacactcactggtttaatgcgattcttcgaaacaacaacacacattcgagctggaaccgcgatgattttgataatcatgctgttccacctggctcaattacgacacaatcgccgcttgtaatagaggccgatggcttactctctgatttggcaaaggctccaaatatcagcctagatgagatgtttttgaacccatctttccaacaagagagtcttattcagcagttgcaaaacttatcagaaagacaaaatagtggcatgatgttgcccaattctaccaacaatttgggtggctcgataaccggggcaccgttctctaatgatcatttaaaaaatccaccaaaaacgaacttcaattctataatcgattctacggacttagattatttactttttaacggagatatataaagaagctttaatatgctaggcaatattgcaatttttcagaattatgaaatttaacatctcccgcctgttggtgcatcaaggagtgtgctgttcctcgtctgggctatagtgtcttatgtcatcgatacaataaatggcgacttttttatagtagctgaagtctgatcttatttgtcgaagtttagctctaaagaattttttgaaagttatcttactgtcaataggtggtaacaagagctctcgaaggttatcattttgagttttaatcgctttactgggttcaagagtcttttctgctttttcccttttgaagaagcaacgtaaacgctgtaattgttgggttaatgaaatactgtccagagatgatggcgtggtcccaggtttatttatttctatcttgataatacaatcagcttcatgcacgtcaccaaattttggcacataagtgaggtgtctcaacccagtacacagatccatatcaatcatagctgtttcatggatatgtaagtttttcaaagaagttggattctcaagaccagtaaccatgccattctgaaatgctaaagcagttcttattgactcggagtcttcggactccatcgaatagttttctttccccatattgatatctgccacggtacttcgaacagaatctttacccaaaatcttatcatcaatagcatggttattggaaaaatttttgttctttgtagacttcaaatatagatgacacatatcaacatctgtttttggtgtcaagggttccaagtcatcctcaaagattttttgacgctcaatttgtctttgttttatctcctctaattccaacgacgtttggcttgtttcctcctccatttgccacaaactgtaaacgtttgttccttctagccacttcatatccactttaacgtaacgagggctgatatcttccgggttaatatccttgtacaatttggctctttccttcaacatcatctttgagaaggaaatagatactttagagtttaaagtatgttcttcagtaacctttgttaaaaattgcgttgggaacttccaagggatcttgatcaccgattgcttcccagtatcgaagagttccggaaaagtttccctcttatcagttaaagaattcattttctgtttacttgcagtacagtgttgaataaaatccttaacatgatataatgtcccacactttagaaaaagattcgcagtgtatagttccaaagcatatttcgttaacggatcttcataattgtgatccatttcaccgttcaaattataaagatcatcaaatttcaaaggttcaatacgaatgtctgcccaaagaagctgtttctcttcaaagatctcaccagtatgattttcaagctgttgattggaaaactgtaaacacaaaataaatttgaacaaacttaattgctgcaaagtttcgacgggactatcccatactggctcaggtagttcaatcattttatcaatacaccattgcttcaactgtcgtccttgtaaactttcaatttccaaaagatgaagaataacttcaccgaaataacgattcaaatcggagtcattacttttctcaccgtagcaaacaagcatagaactcatcctgctttaaatatccaatgagaatagcacaacctgggggtaagcagtattttactgaatacaccaacgtttcatcaagcctcgattgttaaggtaatgtggactaacttatcataatcaaacataaaaaaagacacgctacatatacgcaaagaaagaccagaagataagtttagttcgaaacaaacatgtaatcaagtatacattgaaatcaacattttgtgtcagttttatgctgaaaggaaatgtattccgtccatctttgacaagaaatactgaaatttacacactgacgtgcgtcagctgagcggaaaattgggcgagaaaaaaaaaagactttttttcgccgattaggaagaagaaagaagaatcggagcacgtgaccactgtcattttcaacatggttgggcatgccagaactctccccttatcgatgcatctcgcggtgatacaagcccatttgatatccgtaataaaataaatgatagcaacaatagcagcagtagcagcaacgcaagacattggttttgcaattttctagggaaattgcaaaaaaaaataagaagaggctgtatacaatgcagatagttttataaaaagagatgagctgaaatggctgcggaattgcagaagttattgacttgcaggaagttggagactcgtttttagatttgaaataggaatttgatggggtggcgataaagttgttacaccagctattatacgactttaatactgtgttttcgcgaagatgaacggatttgttaattggtatactgcatctgtgaagagatctcccaggttgaccaatgggataatgactggttcattatttgggatcggtgatgtgattgcacaagttgggttccccgaaaaaaagggtcagaagtacgatcttgcaagaacggttcgggccgttgtatacggttctttgattttctcaataatcggtgattcgtggtacaaattcttgaaccagaaagttatagtgaaaccggggaaacattggaccaacactgccgcaagggtcggatgcgaccaacttctctttgccccggttggtattccaatgtactacggtgtcatgtcaatactcgagggtaaatcgctagttgatgcaaagaaaaagatagaagacaattggtggcccactttggtcacaaactggtatgtttggcctgcgttccaactaattaacttttcattggtaccagtgcatcataggctcttctccgtcaatataatatccatattttggaatgctttcctatctttcaagaattctatttctccaagtgacaagaaagtacctgtgaacttcccaccggttcctgaatagatgaagatgaatatatacatatagacaaaaatgtatttcgaaaaagaactatttatcgtcaaagcctaacgcttgcagcatcagtttaaagctcgggggtttcaacagttctgttgatcatttgttatgtcaccaaagttatcaccgttagcattcaaaattcctctatgcttaggaaactgaatttttcacagggtttttgtttgttatatatggttggtaagatttgtcaaaaacgctaccaaactctacatattcatgtaagaaccgagtctaaagagcatccggcttgcatatgttgaccaatgcttactagaaatattgtgcggacgcgacctttctcgagccacctttttataaggactttgaggcaacagaggttcttttctgacacaacttcggttccgaaaaagaggttaataaattggaaatatgttgcattcggtttggcaggtactggtgtggctttctataacactaacgatactttccatgatttcactaggcacatatacttgactttgggccgtgttggtgttgttactcgggcaacggctcgctgtttctatcattacaaaaagacccttgacgggaaatatcaaaatgatgcggagtatcaaacagcgttgaagaactgccataagagatgtgcagatattactcttaaagcacttgaacgtaatggtggagtgttcatcaagttgggtcaacatattggggctatgacgtacttgctaccgcccgaatggaccgatacgatgattccattgcaggataaatgtccggaatctaccgttcaagaaatagatcaaatgtttcagcaagatctcaaatgtactttggatgaagtgttctctgaatttgatccaagacctattggtgtagcgtcgttggctcaagttcatgttgctaaactaaagtctactggcgaaaaagtagcagtcaagtgccagcaccctcagttgaaggaatttgttccattagatgtgatgcttacccaaacagtttttaatctgttggacgtggtgttcccagaatacccattaacatggctaggggatgaattacagtcttcgatttatattgagctagattttacaaaagaagctgaaaacgccaagaaatccgcagaagattttatcagctgtgtaaacaaaacagcattaagaattcctaaagttgtaagtgctaataagagaatattgatattggaatatctacacggagaaaggttggataatatcaaatacatggacgaacatcacatctcaagatcagaggtctcttcatgtctatctcatatcttcaataggatgattttcactccaaacgttggcattcactgtgatccacatggaggaaacttggccatcagggcgctagaaaagccatataagggtcataatttcgaaatcattctatatgaccacgggttatacagaacacctactacggagatgagacgagactatgccaaattttggttagcgctccttgatcaagaccaagagaaattacattattatgcgaaacagtttgcccatgtcaatgacgagcaggttcccctatttgcagctgcaattactggccgtagtattgataccgcgttgaattacgatatctctaaaccaagatctcaggaggaaatggcagttatgtcttcaaaaataactgaaggagacttgttggttgatttgatgagtattctttcgaaaatacccagtgttgtactattaatcttgaaaacaaatgatctcactcgacacttagacgaatgtctccacaatccattgggccctgaacgaacattcttaattatgagccagtattgctctaagatcgtttatgatgaagctcgtgagacgattaatggatcatattcaagatggtctgtgaaatggatattttgcgaactaaaagcctggttggaattccaacgtcgtaagaaccaattagtcttgtatgatttagctttatggtggaagaacaaattttaaaaatcagttgctgtatatagtttctgaataacttcagtattaaactttttacataccacggtgttctcgaattgatgagactacctcatcaactaacagataccagttttattttaatgatgatcctcgataatttttttggctgtaacgatatccattatagccaatccaacaatttttgacaaagttatagatctggatcccaccagtacttctgtcttaacggaactcactgattcaagttgaccgatttcgatcaactgagagggttcaacttttgcagtgatcaattcaccagcttctaacaaggtgtgttccttggaatcaacgataattttggcatcttccttttggaacaatgataccagttcagtgtcgcattcatgcatatgaggctggtaactaccaatcaacccaatgtaagtgaaaggaatatctgagctttcctggaagaattttttaaagatactaggtgatgaagtggggacagtgccgaagataacgtgactgctgttacaaatcccagctacttcttcactgtcgcttttcacatagttaatattcttaacattattacacgaaccaagcaaatctgcttcatccaataggctagatctgtaaactacgtttaattcaatttccttttcagaaaagagcttagaacacacgaaagaatgccagaacgcttgcaagccggtcccaaacacggtgacattcaacttcgcaatattatcaaatttgtgtttcactttgtacaaaccgatatgagaactcaatgcagttctgataccagtgacctgttttgcatcgacaacaccttggatcaaccctgtagttggttctagtacgttgattgcaccgacaaagcctactctcgaattagcgttataacccaaagtcttcacaccacaataaacgtcatcaacaacaggcatgaacatgtgcatagtgtcccctcgaggggtaaaaaccttggttctagggggaacaattgttggattttcagaatatctggtcagtccatcctgtaatgcttgaaggtgggatataacttctgcccgagaaaggttaagaaaatgagtcttcacttgagggtccagtaaagtcttcaaactcattagtgaaattggctctaaggttcttgagaaacttcgtttctagatcaatggcttacgcacctgaaagaaagcaatactgtaaaacggtttctatcaatcattgtacgctctttttaaagaattggtcgaaaccagggttttggctgcctaattttgatgtctcaaattactcgacggctaatgataagaaaacctaaaaggatgcataaccttgaacaggaaggtaaagagggtattaagccctgcgattctattttgacatttcacacaccagaccgaaggaactactggatatacttgattaaaatgctctgctcggctggcctgtctctttgtatgttcagtttgattcactcctttcttttctttttcctgctgacaacttccatcacgtgaccatcgtatagcgcactcaagaattatgatggggaccttcgtagcgaactctcagtctgttggaataaaatcagtgaaagagaatactggaatacaatcgttgtaggaaattactaatcattcaatattaacgtcttttatccaaatgcaccctgctgagtgccgtcagtaaactctgcactctctcatttggcagtttcttttcacaacatctgtccaaaagcctcgcaggaaaactacacaactcacactcgcctagctttatccaccttaccattccccttaaaacccccacccgctaaacgacgagagaatatcgctaatgcccctcgatgttgtagcttatgttatggcttctaaaaactgtcatctgccattgcatactctttcctttttcttgcgggcttcccaccttctatactgtccaacatcgaaaaagtgagaatgagagaacctttaaaataaatacgaaagagacggactgagatgaatcaggtgttgttattaaaagaagagataatttagtgtacagctcaacagaaagccgtaattctggaataatttacaatttatcgactggaagtacatatatttaccgaatttaactttctttctttcatggttgttgagagagactgtttaagtgattagttttcaatctattcctttacattcattcttgatagcgaaagggcaataggaaaaaagagatcggaccttgagtttgagataccaagtgacgcgttacagtgataagaagttcacgtatatttcgtcaatttttttaactagtttattatcacacacacagtgatagatatacaaaggttagaggtggatattttttgaactatgagctctattacctcacctggaacaggcaccccgcagcagaagcggaagagaaacagagtacccctgagctgtacaatatgtcgaaagaggaaagttaagtgtgacaaaggacggcctcagtgccagcaatgtgtcaagactggtgttggtcatctatgccattatatggaacagacgtgggctgaagaagccgagaaagagctgtcgaaggattcggagttgaagcagcttagagaacgtgtgaagtctttggaagaaactctttcaaaagttcatgccactacgacgaatcctatgaccagtgctaaccagagtccagcgtcagatggtttgaatgtcggttgtcctcatgcaggtggcagtactcaacggctgttatccggatccaatggaaattcacctattctaagtacggaacaaacgccatccaatgagaataagtatgataacgatgagttggatttgacaagacagttcgatatgttacatttgaaaaataatggtactgtgcatcttggagctacccattggttggcaataatgaaaggtgatccttacttaaaacttctctggggtcatatcttcacattaagagagaagctcacggaatggtattctcagaaacggaaatctagtaccgtctccgctggtgcaggtacatgtcccgtcattcatggctcaatacaacaatccaaatgtccagttgcacatgcaactaggaacgttgcagagagaccgaagagctctgagtcacgttgccctgtagcacatgctcctaggcccgagaaaaactccacacaaaaatgccctgttgaccatagtgctttcatcggttctgctagctcgggtcaatgccccgtggcacataccgttgtcaaggaagaagttgacgcaactacttctggatgtccaatagaccacacaaagttttcctctatggaaggttctcctgatcctgcagctaagggaaagcttccggctttgccgtctttccaaaatttgacagcgaaatgtccaatgcttcgcgagggaactccaaccccaacgttgaacagccaggaatctgggcataattcgaaacgcactagtgtagtgccggagatgtcatcagagcaggccactgatgccataagcaaggccttgccaccaaaaaaaatcgtattccttttcatggataaattctttaatcacatttacccaatcgtacctatacttgatgagcagaccttcaaactacaggtaaatcaaattttgcaaacaaataataaccaaacaactgtcaaattgacgaagccgttagatgcttgtgttttggggatattattgattattttgagaataacatggctttccttgactcccaacgcatgcaatatcaagttaggaccagagtgcgaatcgttaaaattagaacctacatactccgctactatcacacaggctaaagaggaagccatgctattaaaatacgaaacacctattgaaacagtggagattgtaaggaaatttttgatcaagtttgatgaaatcagtagtttcgcaaactccaatgttaacatcaccacagttcaatttgccattttctacaaattgtatctcatgtcctctccggataagacggattatacacaacccaacacatttacctcaacgggtcaagataatgagacccaccaagttcttatgtccagtattgtgcaaatggctttcagctgtggattgcaccgtgatcctgataatttccctcaactaaacacagcagtcaatggttccaagttgacgaaagaagctttgtcgaataccgagagattgaaacatacatggaggaaaacctggttctttattgtctcacttgatgttcaacagtctctatcactaggtacacccagattattacgtaatctaaatgacttcagtgacactaaacttccctgtgcatcgaagatcgattatgtgaacaatatcaaggaactcatcctggtcaagaatttcaaattgttcttccaaattgacttatgtatcatctctgttttgaatcatattttgaatgtttctcttgcaaggacagttagaaaatttgagcttgaccaactaatacaaagcttaggtaaactacgtgatggtgttactccgacgaatgatgttgtcaatgatcttgttaataaaggcctattatttaccacagaaggaactgtgcttttggaccaaaacccagagcattcctattcgttaccatccttaacatccgttctttcaacagtagataaaagctcttcagaagaaaaggaaaagaaactcagtctcgcccacgaatccaccacaagagctttgtttttctcaaaacatgtcacaattagcatgctacaatatttgttaaactacatcttattcacgcattacgaaccgttaggtaacgaagaccccggcacaagaattttagctaaagattatgcacaagaagccctcaactatgcagtggaaggcttcaaaaactgcatactcttctataacagcaccggtatgaacaacatgttcagttatatggatgtgcttttgtcgcccacctgcttggacgtcggacatcgtgctttacagtttatcgtttgcctaattttgcgggctaaatgtggccctttaacaggtatgggtgaatccccagctataggtaaccaaaataacactgttactagcagcagcgaagatgaaacagaccaaatgaagagagattcatccccatctccaggaaacgtccttacagatgtcagtctggatgcaggtgaaaacttagccgaagttctcctcgcaagaatgatcttatttcacaagttgacaaaacaaatctctgccaaatataactatgccgtaagaatgacgaaatccacaggtttctttatcactttacttaagaaaccttcctcgaaatccaaaactaactctaaaaacaaaaacctaccacgtttgcatcaacatccaaatattgcaaatatgacgagtttcttcaaaaacgttccatcattggtactttcagcaggaggggatcaaattagacgttgcccggtttatcaggacgcagttgggtttttgccttcgaaagtaacaagcggaaccttcaactcgatttttcactccactgctcctccttctttcaactctgccgttacacaacaattgcccccactgaatatacagtatcaaccaatcacttttagggacactttaagacgcacatcagatgtgagaggtactcctgaaactgcgaaaagaaggaaagtagacaccacatctaaaaacttctctgagcaaaaagttgaagtaaaggtggaaaatcctcaaatatctttaccaccttctccagcgcagatttctgcggtaactccctttgagcctttgcttccaactttggacaaagtgcctgcagttccacaaggaaaggttccatatagcccaacaccaagtttgtctggaacacagcctcctattgttgcaccttctaacttacagcaattaaatttcaactctccagtacccccatcagatttatctaacatcactgattcccctgactttgaggacttcctatccgaacacacatcacttaatggattaatgataaacccgtcatccatagtggaagctgttggatttgatggttattctgggaatggtgggcttcgcttacaagccgatttcttaccgatagataataatgatggcttgaacgaaatggcacccatcacagaattttcgatgtgggaatgagttcattgttacttagatcgttttatttcaaacaaatcaaagggcgtattacaaaagcattttcaaaattaacatcacttctttctaattgtggtagttacgtgccacttatagtttgccttgtcactatccggatagacgtcaaattctttttttctgttctgcttttcagagttcattaattaatggactcatattaatatcgactgtaaataccttaattaaatcatgataaattgttaataactgcaactgcatagcaattcagagcatcagtatagcatcgttagaaatcttccactttcatgaactctgattaaagaaagcctgcttcttttctatacgtatatattaccttatatattaccttatatattacctccgctttcacttacacatcattttcatgcatgctaatatttaagttaatctgagaccgacaactattatcaacgggatgcgagtgggaaaataagaaaaaaagataagaaaaggaagttaagaacgtcagaaatgcagccacttaaccttaaatagagaaatcggatatttcaagagatgactatatataaggttatctgtatcgaagccagaagggttcatcagtccttccagaatgttcgtgtttgtgcaaattgtttgcatgaaccaccagcgacttctgtcgaatataaatgtcattcaacgccagtagaagatccgtcgtatactctacccaaggtgttgttgcgtcaacacagcccttagcaagtgcagccggaataagaattctcgaacttggtggaaattctgttgatgcgagtattgccgttgcatctgtacttgccgtggtagaacctgcatctaccggagtaggtggtgactgttttatgttgcattacgatgagagtaagaaaaaggttgtagggttgaatggtactggtaggtcaccaaaggcactagatattgatcacattcgaagtttgggaattgaagatgttaggattccattaacctccattcatagtgtcactgtacctggtaccatagcaggatggattgatgctattgaaaaatatggcagcggaagagtaggattagatgcaattcttgccccggcgatcaagctttgcaaagaaggacatataattagtgaaatcagtgcttatttgaccggaaaatgttgggaagacctcgaaaggctcaacggcaatgatctattaaaatactgggccccgattgatgcgcccctcgaaccccctaacaccggtagccttgtgcaaaacaggaagctagcagagctcttgcaattggtagcagacaatgggaaagatggattttacaaaggtgtagttgctgaatctataatagaagaaatgaaaacacgcggtggtttaatggatatggatgatttggctgctcataagagtgatttcgttgacccaatatatttggatttcctggagcataaaatttgggaaatacctccaaactctcaagggctcgtagttttacttgcattaggaataataagagagcttgacaaccagaaattgattaatctgcactcaatgcaaagaaattctgtggagtatttacacatgctcattgaatgcctcaagttagccttttatgattcagacgaatatgtgtctgaccctaattgtcaggaagccgacatcctacatcgattactctcaaaggactatttaaagagtcgtgcaaagctattcagccccagtggtatcattgactcttctgttatcaaacatggagttccgaacgaagatttcaatcagtcggacacagtatattttaccgtaagtgacccatatgggaatgtgacatcgttcataaactctttgtatgatggttttggttcttgtattgtgccacgaactttcggaggatttgctctacagaatcgtggggccaactttaaccttacaccaggcactaagaactcattagagcctagtaaaagaccctatcatactattattccttccatcattaccagtaacgatgaatctaccgtttatggaatgggaaatatgggtggtttcatgcaacctagcggccatgtacaacattttttaaatttaattctctttgggttgaatccacaggagtcactggatagcccaagatgttgtctgtctccacatccaaagtattctcatctagaccgaggcagaggatcatccggacctgtcaacactcctgtgtctctcattcagttagaggaagatataccggaagatgtatttgatggtttagttaaactcggtcatgaagtggaatatgtaagaggtttgtccagatcaatatttggacgtggtcagattatcaaaagaactaaaaacaacgagaccaatacctggctatacgcagctggaagtgataaaagaggtgacggggcagctgtacctctgatttaagttacaaatcgggttattttattcataaataggaagaccataaatagttttacaaacctggtagattcaatctatatgtcgtaaaattctttaacaaaattacagtagttctgttttgcatatctttctccatcagttagcaaggattcaggtccacagcaaactagccagctgttttgaagtgcgtgcgactcaatgaactgagctaaatccacctgccagtccaaccttctcccgaaatgcacaagcgatggtgatttcgaatcgttggtcagcaaagcaccggactcatccattgtctccaattcaaagtcgatatcatcaaattcagaactaccattagcattcatagatttagtttgagtatcatctggcggtaagcttcttgtgacatatacttccaagtcattggtttcaaagttacaatggttcaaaatatgcatatcttccctttctctaatcaaccagatgaatttgagatagtctaaattcctggtttgcaggtatttaaatatgctcaacccgaatgaaattccacttcctccaacaacgatagctacacgctgagaatcatacaataatgatggtggaacagtactgtacacatccacaaccgtatattcacctacgacaacgtatggagtgaggttctctctgataataaggtctatttggctctcatctggaagtgaagctatagtgtagggttgagtgggcatcaaccagtacaatggattctttttcttatatttcgaaagacgcagatgggagcctggaagccaatccctaatagcacttctatcaagtttcacgtaggtaagagatgtgtcatcctttaccctctgggtcacattaacagtagttgagtagtagatgtaacttatccccctccaaatgtacaatgccaataagataaagaaatagggaactgtcactcttggtctagcatgaattgggaccaaaaataccatagcccactggcctaattgatgaatgacataaaatgatctataactataacgtctccatattctaacggaagcaaacattaggatgaatagtggaacaaatgcaataactccaataaaattgaatagtttagttgccttggatatcatcgacactttggggtcaagagaccacttaacaatgaaaccaataccatgaataatgcctataacggtaacaaatctagagagccatttatgcaatggaatcaaatccaagtaatggtagcctaaaattgggttcgctggcctcaaagtcaacaacacgttcaatatcactaacacgtatgataatcttcctaatctttttaggtaaagagagatgtacgcaaccaatgaatatttatgtatgaagggaacaaaaaccaatagcaaaagaagtggcatatgaaaacatggtgaagcagtccttatgctctgtaatagcttatttttccatggtgataccttggtatatctggatggtatcagccatctcatgacaataagaaatatggtgtagaatactatgacgccaagcacgtaatatccatacggtaaattggcataatgggtagagctacctctcttaacaagagaagatgcatccatcttgaatgattccccccaggttacttacgttttggctagtttacgctgaggtgagccttttcaggaattcatgtgtaagctataaagagtacaagatctcgagaacactctccatttcgtcattttttttggccttgaagtgcgagagagtatttgagaaatatataaaaacctaaatgactttgcctcgcaggtaatttgctcgagtagcaaccgttacttcgaacatcggcacaactacttagatcgtgcgtatactggaattcgcttttgcaggaacggccgatagagccaaaaaaatttctgttcaaaatctgactttaaccagagaagtcatccagaacatgtacggaataattctttctcagatgtaggaaccgcatgaacgtaagaatgccgtaatcttgtcaaaacgctatgtggaacaatgtttgactagaacaacatcctaataatcccctctcaataaccttcacttttgactattttgtgtttatagtgtaacaatttcagcttcaactatatctagttcaattaaactttgcttcatgtgatatttattagctcattaaggttgatgaaatttacattaacacatcaaaaactactaagcatcggtggtttagtggtaaaatccaacgttgccatcgttgggccccgggttcgattcccggccgatgcattctttttatcccccctttctcttgataacttgtaaattgtcgtaaaccattcaaagcaagttgagccgcgctaggagcactttaagcattccggcactgctacgttacacatatttccacaaatgcaatttattccaatctcactctttctacatcgtttatctaaaattaaacatactatattgtaaacaaaggaatttccggtgcgatacttgtagataatggactgtatacaaaagtgttttgaacggggccttttctgaaccaaaaatccatatcttatctaagcaaaagaataaacaagcttgtttgtatgtgagcatatcaagaaacattatctgatctccgacgcgcacatatacacatgtggtgtatgataaccgactataatcctataaatcctttatcctttcttccctgttatgatctcctgatagaacttaaatgctctctgtccggtggctactagcaatcttaaacgggactgaagattaaataggcatattacccggaaaactctattagggtaaaatttagtaggttttcatcgattgcctcatatttcaagaaagtgggacttttgttccaataagtcatactggctatatatatatacgtcttcactatattgtaaattcttcattggtgtcgttgataaagtacaattgatctggaatatatcttctgagatcagtaaatctctgcagtcatttccgtttttttaacgaattatctcgcaaatattagaccatccttttaaatcagggattatgagcgaacaaccgagtttagtgggtcattctgtccgtgatattgatgatagtgagaatccggacttcgttccagaaaaaatgcctgatttcagccaactgaatgaatctgtgaggagattgaatttgaaaaactcttctcctgacgatagtgaccaatacacttctgttgcagaattgaataaggaaggcgcacttttgaccgatgatcaggatgtagatttagatgacataattgccaaaggattggatgacattagtgaattgaaatcatctttggagaataagaaaaagattaagaacaaaaaaaagacaaagaagtcttcttcgagtggctccttatcgcaagatttcagttactcaatttcgccagtgcattcaggtaccgtagattcccttgtgaccagcactgacccaattgacgataacattgttgctcctaccgctggcgatttaactgacggaggtaagtcaagggccagatcgacaaacaaaaccgagaaacgagctagtgttacgtcagactccagccattcagtgataaggaactcgtatggtgagatcattaatgataactctgaaaggccacacttagctcgtggtgattcataccaacaatcagtagatgatctcgaaaattctgcttccaatggtagaagcggaagatcaacctctaaaagattccaaaacgactacttgcgttcattatctcgttcattacaaagagatcatgctgatcacaaaagtgtttcagatgacacgggcgtgcaagcccaagatatttattcgaccacaagctattctatttcccaacgctatgtggaaaatgcacctcatgtgattcgtgaatctcacgaggagcatacggcgaggcatcctgcagccccccatagaaactaaggcttcaagtgagtctactaatcatgttagagaaaacatcacccaagaaaatcaactagaagaaccagatgaacaagaacaaggactcacagaatcccaacctgaaacggagcaagagctttgcgaaacgaacattgaacccaccagccaaattcctgatatcacagagactaacagcgttccagtcaaaacacgtgatcaatttttctctaaaatccaaaccgattcttctgatattaaagaactccaagaattatcagatgaggagagagatatcaaagacgaacatacatctgaaataaatctgaagggagctattgaaacttcaacgtctagccaaataggtgagtatgagtcacgtgcagccataatcaatgatgaatctatacgcgaggcgaaacagaatcaagaattggagtccgtggcatcaaatgatgaagctggaaaaggtatcggtaccaatgatatcattgacacagctgcatccaaaaattttgtagaaaatttggagcaggaggacgaccaaaagaaattgagaattatcactgaggcccctgaacatgccatggatgaagacgaaattcctataaccaaaataagtccggactctgaaacatcgattgaatacaagggtccacaggaattgggtctacaaacattgtccacagaagaaaatgcacattctaaagcctccaccattgaggcgttgccagaaagcagagcactcaaggatattaatgaagagcaaactcctcagaagggttccctggaaaaacccgaccaagtggaagaagaacagccgaagaacaccgaaaagggctacgctgacgacacattatctaatgagaccgaatttgccgaggaatcaatcgatcactctgaaaattcagaaatacgtatcgaaaaggaagctacgcaagaccaaggattaaatcaggaagctgatttcaacgcggatctttcacaggttaaatctcaagcccatatccccgaagatcacgagccagaagatacgaatgaagcaatagaaccgcaagtagaagatatttcgagtctaggaaactcaagaaatgaaatcaattccgggaatcgtgaagctctaacagagctgaatgaagatgatgtgactggcatatctgaaagcatatccaatgaaaacaaagaggttaccagtgcggctgcagatccaattgaatcagttactgatgagatagactctctcttgaatgaattgaaatcagaattagaagaatccaatgtcggagctcagatagaagaactcgttaaagaagagccggtttttatttttacatccttagctggtggaggtatccatatgcctagaagaacaaacagattggctacaattttaaccgccaatgaaattgaatttacatacagggattgtggtactgattcagaggctagatcaatatggaaaacatacagtgcaggtagattattacctggggttgtaagaggaacatcattgattggtaactggaaagaaattgatgatgcaaatgaagaatatcgactgtacgaaatgatttataatacgctctgaatcaaacttattctggccgattccattatgatttcccaatgaattttatactccatgccctctaacgttaatgcaccaaacaacacagcaggtctcgactatataattcagttcttttgttctctacttctttttattgaaaataaatctagattctggtagtcgtgtaactgtatactcttacagatgtagcttatacgaatcaactaggtacataatgatgtgttcagtgtcttgtcatattggtaattattattgattatcgtgatgcccaagttacttgttgaattgtagttaacctttacgttttgatgatttattgaaagtcaacagtctcgtagtatgttggaagatggcccagaggttgcataatcctgggatcagtccggcaatctgcctgaataaatggtttttttaaacaaagaaaaacaaagaacggatgttcgattatcagcacatgttccttcttgattggtccttacttatactacgttgcattttccagggccagacgggcaaagaaattgttgttatctccttgaaaatatcgggttgaagctgaaaacatgttgtattaaggcatataaaatcaggagacgcgcacgaaagcgagtatctcttattagactttgaatagtcctatcaatatacgtccaagtggccagtttttttttttgtagttttgagctattattcagtgaatatcgagtgatatgtataccacctcccactgcatgcaaatagtgaaggagccacaaaatattaattgtgcgtatcacaaaaaatgataggtaaaaaaagctaaaggaaattcataaataccacagaaaaggccatgatgttaaaaaacacatcaatatgcaagctgaagccgcagaagaacctgtgggaaatatttaaatagaaatgatgtatagagcgacgtgctgcaagctgacctacgcaaattggatcttccttagaaatacatgaaggatctaacggatcttcattacagcaacctgtaccaataaatcctatctttgccacagaaatggatatgttcctgaagtgggtactgcgtaagttatcaccagttacctaatacactcataatggatatttcatgtagacagaaaagtacaaaatgaacgcgttccaattataaaattcaaaccttttctcggagataatacttacagcttattggggtggccatagaaatgactacttttggccagatagccctggccgccatgacaatgtgtcagcttccagttttgctagtacttccacaaatatgacatctatcatcggggataacgacttaacgatcataaaggtcaaatcaaggggcgagggttttgaagccccgaatgcttgcatggcgtcttttagatacttcgccaagtaaatttcacttgcactctggcattttacgcaaagcatccgaagaactgaaaaaaaagggaacaagaagcaatatgatgtaacacgcagaaaatgcctctcatgaatgaatcaaaaatgttgcatcaaaaagcattaagaaatatggaacaatcgaagtatcgttcttaacaacgggtccagatgagtattacgtagctgctgaaacgtatacgcatgttttgcaaataatttccacacttccctctttttccatgtacaataactgatatggtttcatacataccgaaagaatgcaagtaacggcagtcgtcattatccctatgacatggttttgtctctaatctcaatggaaaaaggtgcttttctcaaaccaaggttcgtacactaaggtcgaagcttgagatattgcttttcatgctacattagccactaatgtgaaaagataacatcgaaactctttagattacctttaaatgcctctcttcgtggaagtcggtccaatatcaccaagaccacgacgaatagaggcgcaggagacattcttccatctgtcaaaagaagtgaatatgctgcagccagacaaccaataacacagcattacataagagaagaggtactttttctatcaccgactggaatttaaaagccgtccggaaaatcccattcttagattggacaatctgatgtttaactcttgctttttttctctcccttagcagctcttgctaggaagcaattatcttgtgcaggcttaaagtttcatggagaaccctattgacctggacctgtgcattgtatttctaatcgctacgcgttctgtgcagttatactgagacatcaaatatggctgtgaagaaggagttccaataaagttatttttggattagctaatgtcagggacaaaggaaatgaatgcagctctcccttgcaccagagaatggtctatgggagtgcaatcttccgtcgtccattgacaccagctcggttcgtacagaaagataatatttacctgccgaaaaaaacagaccaggcagtctggtgctggcgtgaggctccccagaaggtctaggcccacacagccaaaacgacttcttcgatcactttagtacgagagggcaggccccagtcccattagtttgtaactggtaactactattccaatcccgtcatcacgtatgcccttcggcaggtacatactaaatgatgagcttatgttttttcccgaaatctcttcttgaggtagaataacaagccattgtttcatgccttgtttgtacggatcattatgacaagtgacgagaagactaactgtgggattaacgatccattcttctacggaatatctgccggtttatttttacgtaaatttgccggtatcctgacgttgtctcaattatgtaattgaagaagaaaagacgtatttttactatgtagttcgaaccccaccaagctatcaagattttttcctcccagatttgtcttaatgcttgccttacaaacgagagaataatagaccaatctagtgtgtcctggttagtctcggaacgtccgcctcacgcagaacttactgctactatttttgacgcgcagcggcaatagattatcaagatccatacaaaaacatgtaatacgccgaaaaaacccgccagagaaaaaaagagattacgtaaacataatacaataaacaaacacacaacggcttcttacgtattgttgtgcgttatcctgttgcattttccctctgcaaacgaggaaaaaaaacctaaacaaagagtcaattgccgacacgtcagaatgcactgaaaaagatacggatgccgtaacctccgattaatcccctattcttttttttgccaggttttctctatcgatacgttatctgactgggctatgcgatatttttctttgttattccatatattatgtaatgctgttgtcataaacaatgttgtattttcagcaaaaggaacggccctaccctaccatctagaaaaaaaaaattccacttttttcttaagacgttattggcttctccttcctgtaggaaaaaaacaacaaaaaagctgacatctgatgacatggaaccatctttctttcccacggcggattctgcagaagccaaattgtcgtacactttcccctattcctctctctcatgtcctacagtcactagctgcccattgaaccatattcccagtatgtcaccgcatgtttacggcaatgtacctaatctaccttgcaatcagacatcgtaatagtaactaatgcaaaaaatttgtctgtttctttcaagaataggaatggactaaggaatttattctccattctaccttcaaagggtcataaaaaagaaagaagaagcttgaacttgagtcttttgttgattcatcctacattaaattgttcgtcaccggaggattccagcttagtttccgcacttaagaggcaataaccatgccataattttgggttcctacgaaatatttggaaaaaacgtaataaaaaaaaaattcgtaggaaaaaaagtgaaggtctctcatcaccccgcagaacaggaaaccagcctcttagtgaaacccgcaccgcaaatagatttccatgagatggttgttcctttttacctaattaaagtttgagaatgcggtaaacaggggactacacagattgtaagagagggaaaataattctcagtccaatacatgctccacaaaagccgaatgagaattggtgacgatatatattcattttgtgacaaaataaaggcgctgcagtatgcaaatacgatgtctgttgcgtaatgtgcgatttcgttatacatgctaatatgatgtatgtttgttttgtattctcgttatcatgccacttctgatttgagggttctagctcactttggatttagttatcattattaaggtatttagcagttactatttaatgcctgtttatacgtaatacgtgctatatggcatttattagaaggcatatatatatatatatgtagcagtcgtgactgtttaagattttccttcgttttattgttgttcgaaccttattacataaggaaacattatattttaatcatattacgatattataatattatataacaactgaaaaagtctcgtcaagtcgaacaaagattcatttacaatccaaagtataaaggaatcagaccgcgtcgtatcgttaactgttaatttgcactataagtggaagtaaacgtaaaactcaaaaacggattaagtgcaatactattttattattacggaaatctttttcatttcacacttttttctcttttttctaaacttttcactgcctctgcaaagtttttaaaggaattatttcaaagtataaaagagatagaatcttttttgctactccatattcatcacattagtgaacagaaagccataactacccaggaaaggagcatactgatatcaatttatcactttttttcactgttatatcttcttctcttttttagtacttcccgttccctttttttttttttttttttttattcaggtttattttttctttgtcagaaattaaaaacctcgtctagtagacacctagaagaataaagactcaaagaatacttaagagagaataccaagagacgtactgattcgtggcggtttacaacaaaaaatagtgaaaagaagcctaggaatcagcagagaatataatgcacgattagaaactgagacgttcattaaagaatacaacagataaaacggttaagagactgttttagaataatcgaaccccatattattgaaggtagaatttgaaagtcagttagtgtgttattcattctacactaaagtctactcgatattatagtcttactgagatatattttatcatacattttgcccatctcatccaagaagatatactgataagaaagatatgcctgacttgagaaatatcgctattgatatggtgaacttcaccgtatcgaatgtcaatgatgccatttcattcaaaccacatctttgtagagaggtacctcaacaacaatacaacgctttgaagaattggtacattgaatttactggtacttccattcgtaagaataagtgtaggttgtttttcttaccaattaacgtgtccgatgagctgcaacagctgaaccccgttattcctgatgaagtcaagatcaccagtcccgatgacagcaatgtaatctattacaagaacagattgatcacagaactcgactttgaaaatgtcaagcgtgttcagagagcttgtatttatattgcttatgctgctgtcaaccaactgctaaatttggaaacggatccatctatgatcttggagtcgaatcagtcgactgccactgctactaacatgggcaacggaactgccccttcatctgcagcatcttctcatgcaaatgttgatggattagaccctatggaatcatgccacatatctttaaaaagaggtgaagttttaggattcagagagttaggtcacttgataagcatcacgccatggcatttccatcgtgtctttaaagtgatcactggtttaaccattcgtgaatatggtcaattgtgtgtcgaatttttgaagaagaactgcagtttggtcaaccctgttaaaacaagagtagctaagttgaaggaaaacggtgattcttactcctgtcttgacgatgaaaatttcatgaacgatgatactgtcaagtacgagtgtgatgacaactgtgtcattttacccgattacttcattgatttgaccaaatccaaggaatccaaaagaaaatcgaatgattctccaccatccagtgcaccttctaaccgttccgctaacaacggtattgatttcactagtgaaaacgattcatctaagaaccatcatccaacttctgggttatcacgttcggaacagcgtaaacgcagaagctctgtaatgattcaaaagattagaaatgcatctatttgcactttctcatcgaacccctctattcaatctgctttgaataaccccggaacccctattcaaagctctgattacaaatctttgacaccttcacctggtaaccaaagtaatcatgttcaatcttatgattttgctccttatctgcgccatccttctacatcgactattggattaagacggaaatccaaggctagtcgtaacggtagcgttgctgggttggaagctcacggaatggtttccaagcccaagcataaaagaaacactagcgaacctactgttaacaatgatataaacattagggagggatatttgactagtaagatgtctaataatcaagcgctaaatgacgttacaaacaacgatactggacaaaaccaaggtctagcggaagcgttcacgttcccatctcctcaagttgctttcaagtttaacatgttcgacgaatcaaacttgaacaacttggacatggacatgaacttgaactctatgaacctatctgagatggctttgaattccatctctacaaacatggatgcgttgactcctttgaaccaactcgagaacaatctcagtgctcctgaaacatcaaatactgctacgtctggtaccacaactacgacaactacagatattgatttgaaccttgccatggacgacattacagaaatgtctgccctatctctaaattcaaacgctcaatttcaatacgttcatatggataagccacagcaacagcagctacaatctcttaactttaacaatggcccactacatctagacgctacccatcaacaccaaataagcgaaccccaaagcttgagttctacactaccaaccactcctcaggatgtcagtgctttgttaccgttacaaggtcatgattcgttgttaatggaattttccccagaggaacctggcaacatcgcatctagtgtggatccattattcccattgtatccctcgtccatgttaaccgctatgcccagcgacgcttttgcaacttatgaggatttcatcgcgaactaattcggaaacgcgcgttgtaatatagctcattcttattttttcactacccttctcttacttcacttaagaactttctattccaatagtatattattactttcaattcttttattttttcccgttctttccatttgtatttttgtctaattgattaagtattgattaatagaaagaatgaacttttttatttgactttacttctatcttcaggccagctgatccattctcttccctaatgatagaggatacctactttttcccatgatgccgatgcaaaacctccaggcaaagaatgaaaaatcaccacacattgaaaaataagacatacagttacccgtattttgatgtaaccctggcaattgttccctattttacttgttgtttgtttgtgttttctatttttccccagcaacattccagcatctacgagagtttctgtccaagtttctccgcttcttcgtttctccatagtttttttttctctttggaatcatgagacgacccagtcgagagaaaaatccagtgcccagctcgtggcgcacaggtcgtggactggtggtagctagctactcgtagtccttgacccttggtaattggcccttaatccatatttttattttttgttacctagttcccactgcgctgcttttatttaggtgaaaagttgagaagaattaaatattaaaataggaacttgaagttttgaaacaactaactatatatgcaggcaacttgttggggttttcctagtggaacagacattgtttcccctttttatctattgatattttaaggttttataagcagtatataccatacaaatagccaaaggtttgtgaaacaaaaggttgaggtttaggttaaggtttgggggagtttataaatatttataaatttggtctcttttgaaattgagttttgaacaaagggaaacaagtaatttacacagaccttcctgctataggctacttaggataaaaggactgactaagcattcgtatttgtattagattgcatttttttttggcataaacttcttctcccttcgctatgactcgtgatattgtgaaccatttggtgttcgaagtggcgactgaggttgctaataaggtgggtggtatttattcggtgttgaaatcgaaggctcctatcacttgcaaacagtacggtcctaaatatttactgctgggaccattgaacccacaatccgtgcaagttgaagtggaacccgtggattgggaagacgaatccaacttccatattaaagaggttcaatggtctcttagatctatgcataaccgtggtgtccgcttcacttacggtagatggttgattgatggtgctccaatggttattcttttcgatttgaactctgttagaaattatttgaatgaatggaaggcggatttatgggaaatcgccggtatcccatcccctgatggtgattttgaaaccaacgatgccatcttattgggttatactgtggcatggttccttggtgaattggcccatatgaaccagacaaatgccatcgtggcacatttccacgaatggttggctggtgttgctatcccgttgtgcagaaaacgtaggattgatgtggtcaccattttcactactcatgccactttgttgggtagatacctatgtgccggcaatgtggatttctacaataatctcgacaagtttgacgtggatgcagaggctggcaaacgtggtatctatcatcgttattgtatcgaacgtgcggcagctcatagcgctgacgttttcactactgtttcacagattactgcatacgaaagtgaataccttttgaaacggaaacctgatgggatcttaccaaatgggctaaatgtcatcaaattccaagccgtccatgaattccaaaatttacatgcattgaagaaggagaaaattaacgacttcatcagaggtcatttccatggtcagttcgatttcgatcttgaaaaaactttgtacttcttcattgcaggtcgttatgaataccgtaacaagggtgctgatatgttcattgaatcattggcaagattgaaccacagattgaaggcatctggatctaaaatgactgttgtcgccttcatcatcatgcccgcaaaaaataaatcatacacagtcgatgagctacgcggccaagctgtggtcaggcaactggaaaactcagtgaaagatgtcacacaattgatcggtaagagaatctttgaacacgccatgagatatcctcataatggcaccaaaactgaaattccaactagccttgacgaacttttcaaaccaagtgataaagttgtattgaaaaaacgtgtatttgcattgcgtagaccagaaggtactttacctcctattgttactcacaacatggtggatgatgccaatgatcctattttgaaccagatcagacgtgttcaattgttcaataattcatatgaccgtgtcaagatcattttccatccagaatttttaaacgccaacaatccaatcttgtctcttgactatgacgaatttgtgagaggttgccatttgggtgtgtttccctcatattacgaaccatggggctacacaccagcagaatgtaccgtcatgggtatcccatcaattactactaatttgtctggtttcggtgcttatatggaagatttgattgaaaaggaccaagccaaggattatggtatttatatcgtggaccgtcgtttcaagaatcctaacgaatctgtagaacagttggttgattacatggaagatttcgtgaacaaaacacgtagacaaagaatcaaccaaagaaacagaactgaacgtctttcagatttgttagactggagacgtatgggtcttgaatatgtcaaggcaagacaacttgccttgcgcagagcttatcctgacgaatttaaagaattaactggtggtaccgatttagatgattcaaatatggattcattggccggtaatccaaaggttaaagttgccagaccattgagtgttccaggatctcctagggattcaagagctagcagtgtgggtgctgtaatgatgactccaggtgatttaggtactttacaggatgccaacaatgctgatgattacttccatctatctatgggcgataacgaggatgacgaagatgaagaccaattcaactaatagcctttaaaacacttctattactagcatctttcgctactttaataccattccatacatattaatatcaaaacttcaactattgtcgcagattaatatataacaagcacaaattgcaccgcatgaatttacaaaagtaatgtatgcattaaatatatacttataacttagcacattgatcaactgaaggatactgacaaaggtaacatcaaggagccggagctactttagaccactcacacgtgttatattgacagatcagaatctgcgattatcttgtgtacattctgtacacgtgacgtgacttatttttcaaagccttctctgcattgatttgcaacttaaggatgaaatcaggaagtcaaaattcataaaaaaggttcaaaaatgcaaaagccctagcatttaaaagccaccgtcattgatctaacggaagagacattcccataaagcaaagctatagccgagagaacatccaggtaagctagacagataaatattactttacgcaactattcttcgatgtttaaaaaagaacccttatcggaaaataatagtcgtaagcctgaggagccagaaccagtcgaagggcataaattgaccaaactgttcaataaagttacaggacaacctagttcttatgttaacaagtcagattacatcttcggtaaaacgttaggggcaggtaccttcggtgttgttagacaagcccgttgtatttcttctggtgagaatgtcgcggtgaaaatattgttgaagaaagctttgaagggccagtcagtacaactacagatgctatatgacgaactatccatattacaacaactaaatcacccaaatattgtgagatttaaggattggtttgaatccaaggagaagttctatattgttactcaattagctactggaggtgagctatttgatcgtatcttggaaaaggggaaattttgcgaagttgatgcagtattcatcgtgaagcagattctacaaggtgttcaatatttgcatcagaggaatattgtgcatagagacttgaaaccggagaatattttgtatttgaataaatcagatgattctcctttggtgataggtgatttcggtattgcgaaggaattgaaagatgataatgaactaattcataaagcagcagggtctatgggttatgttgccccagaagttttaacatcttctggccacggtaaaccgtgtgacatttggtcaatcggtgttatcacgtacacgttgctatgtggatattctccatttttagctgaaagtgcggatggattcatcgaagaatgcaccagtggtcagtacccagtagtattccacaagccatactggaataacgtatctaagaccgcaaaagagttcatattatgggcattgacggtgagcccaaaaagaaggcctactgcaacagatttgataaatgatatctggatcacttctaccgaaaaatcaaccactgatttgcttccagaaatccgcaaaggtttcgatgctcgtaaggaattccgtgatgctgttgaaatcgttaaattaaataacagaatcaaaaagttgaaggtcctttatgagaaccaagatgaatctgataccgatatcgaggttaactcaactgatagcttttctaagaatgattattctgcagactcgttgcaaagttcattgaaaagtctatcaataaaggatagtcatacagaattgaaatcttctctcacccaaaacgccttcgcgcagcttgttctgactgcgtctaaaaacaaagaaaaagtaaagagcttccaggactcaggaaactagaagtttcactatctactgaatatttcaagattattatcatatgatcattaggagataactgcgcatgtataacttaacaaccatcaaaagtagcaccggtttcagtttcattcaattacataagttattataacatctaataaggacgattttccctttaaaatcaacatttgtgggcattggcttggcatgttacgggatcatcggataggttgtatttatgttgaaacggatcataaactatgatcgggtaactaccaatataataggcggttaagtatcaagatgatacataaggattgtttctagttgaaacatcattaaccaatctgagttattatataaggaggcattagatctggacaaagacgatcaacacagtcatgacagatcgctaggtgcatcaacatacactactagatatatagctaataaagaatatggattcatcagataccaaagatcttgagacaacaacacgtgactggaaataccagtatcaccaacaatttaaccactacacttgtagcaagaggtatggtccagtttgaagggatgggggtcgtatacttgcttcagtagctcagtcggaagagcgtcagtctcataatctgaaggtcgagagttcgaacctcccctggagcattatttttgtcaaaataaaaaatatctaccaatatgataaaaatagcttttactcgcaaagagtgaacggccatccattcggttgacttaggatacattttttggttcactactcattctggcaccaataaatttgatttaatttaagatgatatacattatacaggcacttatttgagctttcgctttttgtgtgttacggcattctttgagtttttcttcaaaggcctcccacgtttcttaggaacgtcttcgttgtcttcggaatccaattgatattcttcttcaatctcctcatcattatctgaatgatcttcatagtcattcctgtgatcttcgtgctcagagaaaatttcaggctcttcatccatttcctcctcaggttgatcttcctcttcttcaacattcgcaacaacctcttcatcatcgtcagagggttcctgtggagcttcagtatagttaattttagtcctttgagatcttctcaagttccggtccgtcgttgagatatcaccatactcaacctttagttgctcaaaggtttgtagtagtgatgacattttctgcaagtattccttcaatatcaagaattttgatcttgatttgttgtatttgtattcttttggtaatggattgcagttaaatccctctactgtatctaatttagtgattgttgtgtccttcttcaacaaaccggccgaaggcaggccattcgatggttcttctttatctgagcctatgtctgaagcgtttaccgtgtccttttgatttgcttccttcgaatcgtcgactgtctttttatttttgtttggttcttcctccttgaacactttatactccaatagtttgatgaaatcttgcaatgaagaactgttatggcacatttcataccagtaaacttttccggtattggtaccattcatcaaatcgtgaaccaacccaggggtgtcatgataatacaatttaaactgcatactgttcaacttaccatccctactgaatagttcgaagggtgtaattgttccattttcaaactgttgtaatgtcttcaacaatgttatgggatcacaataattagtcggaatatgctttttagcttttgaagattgataagtaaacaaccttggcaagtaaaaatctccaacgtagggaattcttccaataaagaattcgagacatcttaatttgtatatttcatcttcataggggtcatccaaaggttcccgatcatgaatttcttcgaagaccaatttagaccatttcgaatagtcccgttccacgcttactgctaacgcgtcaaacttctttttcttatctgttgtgacttggttgtactcttgtctatactctctcatattttttttgagttcatccagtaaagcgaactttgcagataaatcttgacgggtaccactttcaagttgttttttgacatgctttttggatctacgcaattccattctttcctttaccaaagtacatagcttcttgaaatgttgatgagcagcatctatgccctgaacaagatgtcttggagcgtggaaggtttgaataccaaaagaggggtctttctttagatgcgataaacggtatatctctgtgtgtatcttctctgaatatgaaatacaccactgcgtcaatgtccttaaaaatacgaccctgtcagatggcattagtcccaaaagaccaagtcgttccaaatctggattatgtaatgggtcttcttccaagggcacgatcaattgctcagtccacttgtaaatgtttggggttaagatctcaggatgattaggatcaacagcttcagtgtcatcgtgttcaaacaatttagtgcgttccgcatttaaagttgactggaccttccattctctaggatatccaaattccacccctttatgtctcaattcagatattagtttgaatgctttggatgaagtctgcagggattgcaatgtgctatgcgatttgcgattcaaagtcagctccattaatacaacataaagtaaatttgagtaatcctggcagcgtctaatttcccttgctggaatataatctgcataatactgaggaagatcctgttcgtcgtctatattttctgggtaaatatcaaggccaatttcgaggtcttgaatagataaagaccatagttcctgaggcaaaaatttatgaaatttgttgatgaatgacatgacaaagaccagatcctttgcatatggtgctttcctcatatgagggaacttcaatctcgaaaaaacagatgtttgggtcttgaagtcagtagataggactggtaattgtggtgcccaattttcgaggagaattgggttaacagctaaacttaacgaaggtgctggttttgatgcagatttagaaagcttgatcgcatccttaggtagaactggcttcgatgtttttccatccgatcgactttctaaatcaccggagggtttgggagaatcctttttcttcaaatcgtcagcggtttgtttcttagagatcatgctagcaacactttctttcggtttgccattggtttcaacatcgcttttgcttttcatattagcctttttacttgttgtgctattttttttatcactgttggcattgatggcagactttttttgggcattctttgccttttccttatccttatcattgtccttatcacttttcttcggcttagccttattggtattggatggcctatcattcttctttcccttcttcgtcttagcgaccactttcctattataaggccttttctttctggagtgttctggttcttcatcgctttccacttttctcttgactagcactctatttgatcttcttctcgatataggttcattcaatggagaagtgtctgtatttgattctgatagctgaacggcaaaattcttaaagtctgtgatagaggtttgcccgtatttcttcgccacgggatgttcctcgggaactacctcgatcatttcttccttattctgagtttccattgcacgaatggtaaaagacttatcaaacgtgtaaagtatcttttactaccttcctgtggattaataccgaataatgtaattgttaaattgattagcaaacaaaaactggaatgatcaaatcctttcttcagctggtattactagtctaaatggacttaaaacaaagacaaccagtctttaagttctgctgtatcgagcactgactatcgaataggagaagttacaggtctggtgaattagactcactgcttgatctttaaattgcagaaagtcgtttatttaaacaaacctggtcctcgttgtaaaaactttttgttcctttcatgatttctatcaaatcgattctttcgttggaaagtaaagtaggtcgacgcgttattctgccaattaggcggcaggttcccaggccatcgaagggaaaaaaaaccaaattccaaggtcacgtgcacaaattgttagactggatgccaatggttttaccaggaacaaactaaacgtagtgaaaggtattggcagcgtgaataccgtagcgtttatacataatattcaagggataagatgcgattatatacagaggaagtgattgtgaaggggaatagacattatgtttcagtactttcttttaatttccaagagcgaactgggaatgacgtgaaagggcgaaaaataggagaagctggcagtcctagtaacttgaaacctgcactgaacattcttactttcatattgaatgactggaattttcatctagcgatagaaataagtagaacattctttgctgtatggaagaaggtccctgtatggtcaaaattctttctaagagccgaaagttaccggataggacattctaaaagttaccgggtaccaagctataacgatagttagctttgccaacccttacaaaaaagctcaaccgcacacatctattagcctgaataactctaaaaaatatatcgaagcttatatgcacatcctcgtctcatctcatcactgcatatttcggcagaaataattaaagttcttgtacataaatgcaaagagtgaaaaaaaagttgcagcctcactatcagccatcttgatgagaagcaaatatataacggagtaaagaagatccatcggtgtgaacttctgaggcaaacacaaaacatacccttcgatacgcaaggatgacggctcgaccagagttgaacactttacatagtgctgccacagaaccgacaattatccattcgaataatgaaagcctgaatgctttagactacacaggaaatgatgataaaagtgttgctctgagcaatgctatcagccgaacaaactcgacaggaaataagataccaaagaaacggaagcccagacggatgttcactacgcctggtagattccaacagcaattggcaattccaacgagttatttggagagaaaaccaacaaccaaggcagaagccaaagggttttactattttgtatcctgcatgaaacagggaaaaataatgctgtttgatcaaacattagataggatcgatcaatgctatgataccatgtggacatggcccggttttagtcatggtgtagacttttatcagtcccataaagatgcgaaagttttgggtacttttttacaagtgttaagatgttgctttgataccaggtcgattgtatttcttccgttgttcccagtaggaattgttttttataagagagaggaagatattccagctgtaatttgtttattgttggctctaatgtattttgcaaaattgttatccaatacgacggagtatgcgagcgagcattttggacccgtttttggctcgttattgaacgctacgtttggtaatctagttgaattgatcatctcaggtactactgtctccaaagatgacgctattcttaccattacttcattaattggtagtgttatttccaataatttattagtgattggttcgtgcttctttttcggcgggcttgatggtgtgataatgcactcgaaagctgccatagcaaaccatttattctttctttccagtgtcacaatggctttatccttgacttctgtgatagctgtaattgattctgggaaatcactacgttttaagatggatacttcgcaaattggcgcagcgttgattttcctatgttacatcatctatctaatagtgtccactaaccaagaattcaaagcattgagcagtaagaaattaaaagaaaggtctttgaaggaatctgacatagaaactttgccggaacttgattccgatagcgatttcgaattcagtgtgggagacaaaaaagatgacgaagaaaaagatctcccacctaagttagtttgtttcataacattagcgatcgctacagctggattaggcccaacggcgaatttttttgttgaatctttaaaggaattgactgacgataaaccgatctcaaaagttttcattggtttgataattttacccttggctggttcgctaccagaacatatctcatctttgatatctgctcatcatggccaaatggatcttgcggtatctctagccatcggatccagtaaccaggttttgggtatggtacttccaattgtccagcttatctcctccagatacccaagaaccggattcacattgtattttgaaccatatgttgccggatacctattcagttcaacatttgtatgttgtttcacattaattcatggtctactattttctgtgaatatcttacacggaacccttctactagccacatttggcttcataatctatttgactttcgccaactagtaacataatatatcaggttaagtaaagacgtagcgatagttccaatctcaatggagttttcttatcttccatattacaatttggtatgttccaaaactttcttatcaacatatgagtatgcgttttaagcttaaggttaggattgccaattcttaacctattctcctctaaggtcatctgtatggggggtttagttagttttatgcagaccacattttaaggaagtgggaagatttcaaggtccgggtaataacctggaattcttttctgaagaaaacgtttcttttattccctgctagatcgttttgaaaattttcatgatttgaagctcatctcatctcatctcagctaatgaaaccagacaaagaagaatattaaatcggaaacagtaggtcattcttcatcaagttttcgtaaccggtaggccaagttgtgttaggtattattacttcgtcgattgagtgactggtgaatagactcgtttattttttttagtgcgccatcggtgttaacgaaagagtaataataatatccgggaaaaacagtctaagtcaagatggatatttccaaacctgttggtgccgaaattaccagcatagacttcagcgtcttgacttctgatgaaatccgtaagttgtcagctaaacaagtcacaaatcctactgtgttggataatctaggacatcctatccaaggtggtttgtatgatttagctcttggtgcctttttgaagaatttgtgtgcaacctgtgggttggatgaaaagttctgtccaggtcatcaaggccacattgagctacccgttccatgttacaacccactgtttttcaaccaattgtacatctacttgagatcatcctgtcttttctgtcatcatttcagattgaaatctagtgaagttcatttgtacgcatgtaagctaaggttgttgcaatatgcccttatcgatgagagatatcaaattgataacatcagaatcaaccaaatggttgatgaggatgaagctgaagaaggtgaagaggaagctgatattaacggtaagactacaaattcgagcggcactcaacatgctttgagagagttaagaagaaaacgtaacgaatttgtcgatatggctattgctaaggctctttctgaaggtagaaccactgagcacggaactttcactgctacagttaacgatgaaagaaaggccttaatacatgatttccataagagattgctatcaagacctaagtgtgataactgtggtatgttctctcctaagtttagaaaggatggttttaccaagatctttgaaactgctttgactgacaaacaaataacaaataacagggtaaaaggtttgattcgtcaagatatgattaaaaagaagaaccaaatgaagaaactgcaagtaaacgatacttcttctgaatctgcatcgagagacgaagatggagaatttggaaccgctagatcaccagttaacttgaaaccaaagactggttccacttatattctctctacagaagttagaaatattttgagagctgttttcagaagcgaacaggaagtactacaatatgtattcttctccagaccaaaccataataaaaagatagtcacagccgacatgttctttatggaagttctaattgttccaccaactagattccgtttaccttccaagttgggcgatgaagtccacgaaaacacccaaaaccagttgttgtcaaagatcttaacaacatcactgctaatcagggatcttaacgatgaaatgtcgcgcttacaaaaggataaagtatctgctgatgatagaaaggtaatctttaacagattgatgaatgcttttgttaccattcagaacgatgtaaatgccttcattgattcaacaaaggcgcaaagcagttcaggcaacaaggtaccaatccctggtctcaagcaagcattggaaaagaaagaaggtttgttcagaaaacatatgatgggtaaacgtgtgaactacgctgctcgttcagtcatttctccagatccaaatattgaaacaaatgaaattggtgtgccaccagtgtttgcaacgaagttaacatacccagagcctgttactgcatacaatgtggcagaattacgccaagctgttatcaatggtccagataaatggccaggtgcaacacaaattcaaaacgaagatggatccttcgtttctttggttggaatgactcttgaacaacggaaggctttagccaatcaattattgactccttctacccatgatgttgcacattccattaataagaaagtgtaccgtcatatcaaaaacagagatgttgttattatgaaccgtcaaccaactttacataaagcttctatgatgggtcacaaagttagagttctaccaggtgagaagactttgcgtttgcattatgccaatactggtgcttacaacgccgattttgatggtgatgaaatgaatatgcacttcccacaaaacgaaaatgcaaaagctgaagcattgaatctagccaatactgactctcaatacttgacaccaacatccggttctccagtaagaggtcttatccaagatcacatttctgcaggtgtttggttaactagcaaagactcatttttcactagagaacaatatcagcagtatatttatggttgtattcgtcctgaagatggacatgctactcgtaacaaattggtcactattcctccagcagtcatgaagcctgaacctttatggactggtaaacaaataattactacagttttactgaacacttgtcctgctaacatgccaggtatcaatttgaactccaagaacaagatcaagaatgaatattggggcaagtcttcggaagagaataatgttgttttcaaagatggtcaattattatgtggtattttagacaagtcacaatatggtgcctccaaattcggtatcgttcattccctacacgaagtatatggcccagacgtagctgctaaagtgttatccgttctcggtagactattcacaaactacatcactgctaccgcatttacttgtggtatggacgatttgcgtttaacagctgagggtaacaaatggagaaatgacattcttcaaacatccgttgacatcggtagagttgccgcagcagaagtgacgaatctagacaaagatgtcaagtcagatgatggtgagttgctcaaacgtttagaggaaatcttgcgtgatgataacaagttaggtattctggatgctatcacgtcctctaaggtcaacagtatcacttcacaagttgtttccaagtgtgtaccagatggtaccatgaaaaagttcccttacaattctatgcaagctatggctctttctggtgccaaaggttccaatgtgaacgtttcccaaatcatgtgtttattgggtcaacaagccttagaaggtagaagagttcccgtgatggtttctggtaagacgttaccatccttcaaaccatttgaaactgatgcaagagctggtggttatattaagggccggttctactctggtatcagaccccaggagtattacttccattgtatggctggtcgtgaaggtcttatcgatacagctgtcaagacttctagatctggttacttgcagcgttgtttgaccaagcaattggaaggcgtacatatttcgtacgacaactctgttagagatggtgatggtacgttgatccaattcttatacggtggtgacgctgttgatataaccaaagagtcacacatgacagaatttaaattctgtgtcgacaattatgatgctttgttaaagaaatacaatccatcagcattagtcgatcatttggatgttgagtctgcattgaaatactctaaaaaaacattgaaaaacagaaagaaaaattccaaacttcctcattatgctcaaacctcaaaatacgaccctgtattatccaaattcaatccgtctaaatatttgggtgctgtttctgagaacttccaagataaactggagaaattcatcagtactaatgatgacttctttaaaaaggatgaaaatgtcaatgaaaagaaattcagagcattgatgcaattgaaatatatgcgttctttgattaatccaggtgaagctgtgggtattattgcttctcaatctgttggtgaaccttcaacacagatgacgttgaatactttccatttcgcaggtcacggtgcagctaacgtgacattgggtattcctcgtatgagagaaattatcatgaccgcttctgctgcaataaaaaccccacaattgaccatgcctatcagagatgacgtatcagatgaattagcagatactttctgtaaaaacatcactaaagttatgctctcggaagtcattgacaaagtccaagttacggaaactattggcgctcaagactcttctacttcttcacgttcttatattatcaacgtcagattcttcgattctgaagaatatttggaggaatatgatgttactaaagaggaattagagtctgtcattgctggcaagtttatcaaaactctagaagccgctattgtgaaggaaatcaaaaagcaaaagaaaacatctttgcctgatgttggtattgctttaccaaagtcccaaaccgcaatgggtgcggatgaaagaattacaaatgttgaagaagataatgatgaagaacaaatgcgtaagaagtctaaagaatctgtttcctatgatgaccctgatgaagatgaagttgaaaccatgagacaagccgaacaaacctcggatgaagagttcgattctgacaaagaatctgaatccgagtcggatgaagatatggacgaggcaaaagaagagagagaaaatggtaaacacatgacaaaagagcaacgtgatcgtcaatctgctctaatatcatcgacaaggtttgttaccaagtataactttgacgatgatgaaggtaaatggtgtgaatttaaacttgagcttgccggcgacaccgagaaattgttaatggttaacattgtcgaagatatctgccgtaaatccatcattagacaagttcctcatatcgaccgttgtgttcaccctgaacctgagaatggtaagcgtgttcttgtcacagaaggtgtcaacttccaagccatgtgggaccaagacgactttatcgatatcaatggcattagatcaaacgatgttgccgcagttctaaagacttacggtgttgaggcggcaagaaacacgattgtcaatgaaattaacaatgtcttttctcgttatgctatttctgtttccttccgtcatttggatttgattgcggatatgatgactagacaaggtaactatcttgctttcaacagacaaggaatggaatcctccacatcttccttgatgaagatgtcatacgaaacaacttgtcagttcttaacaaaagctgttctagataatgagcacgaagaactaaaatcaccatctgctaaaattgtcatgggtaaattgaatggcgttggtactggttcctttgacctcctctccaaggcaccaatgtaaaatagaatgcttaataactgtatataacatatagattagttgaaattaagaatatttttaagataatcggtcattgccttacactagatcgagcttgcgttcaagaagatatgtactttacaacttttacataatttacaggtaaatgctatttaactattcgattccaaagactggctttagtttacgaatcaacatccaatcagattttggaacttgatctctgaaagcaggatctttcaatgtatcaatggaccttctagtgatgtgagaatacaatgtatctttttcatcaacatgacgaccccagattggttgctgaccggaaggatcttctaaacgcattgcaacacctgcattggtttgacccttcttgacttcagtcacagattggtgattgatttccaaggaagtgactctaccaagcaacaatgttattctctcctttgttgctgggtcatatttcactgcacagataggagtaccgatcttcaatgaaccttcaatgacatccacaccaatgatcatagggccacgcttgttaatgatttgtagagtgttcaggacgcatgggaaggtagcgtcaccgataaactcagcacgacgcttttcaagtagttccttctggtaggctgtgaaggcatcgaataaatggtaaataatatcagcattgaaaattttgatatgttgttctgcagcatattgttctgcttccttatcaaccttgacatcaaagcatagcataaccgctaattcaggagctttttctaacatagtacaagccttcattatatcacgcttgtaaacaggacctaatccgacagacataacaggaattttcatgtcttttaagaagtctaataaagcttctaatgaacccaatgtagaagcttgaacaacaacacctctaccagaagtatccacagagtctaaaagaccagtcaaatcttccatgacgtcatccatcatttcttcttcatcatcgtctggacctacaactaataatcgggaaccagaaacagccttttccaaatcatttgcagcaatttttacacctagagcagccttgacttctttgtgatgttgatattcagacttcaaacgtaactcacgtaagggttgaggtgtcaacaaggctctgatattcgtcacaatcggaccgttcataccacataaaacgattctgtcaccctctcttaagtaaccattagatagaataacatcgatagtggtaccgaaaccttcaacaaccttcacttcaagaattgtagcttcaacgtgagacaaatatttcaattgcttagacattctcttttgagtcaattctaatagcaaccacaacaaatcaggaacaccttcacctgtaacggcagatgttggaacaatagagacgtatttggctaggttgttgttttggaaatacaattctgagttcaaaccttgttcagcaagagcgactttgatgttgtcaagtctagtttggaactcttgcttaactgctcgttcttgtttgtcaaaggagtctctgaaagagttgtttggtgtaattacccagtcgtacaatctatcgatcttattcaaggcaacgatgaaaggagcctttctgtctctcaataatctgatggattcaatggtttgttgttctaaaccatgcatgatatcaataactaagatggcgatgttacacaaagaggaacctctggaacgcaagttggtaaaagattcgtgacctggtgtatcaatgactaacaaacctgggacatcgaaggtttgttcttcatacttagccataactgcggttttttgttcaatagcgtcaattgggaaataagtggcaccgatttgttgggtaataccaccagcttcaccgccttgaacgttggtttgtctaatcttatctaacaacttggttttaccagtatcgacatgacccaagatacagcagattggagaacgaagatctttctttgctgctgctgcagatctcttggaagggattggttgagaagcatagtttttggtaacttcagtggataattccggagctggagtagtagcattagaagtttcagaaccagaatattgctctttttcacttgtttcttcttttccttcttgttcttcaggttcatcgtcaagagccaaattctcccagtcatcaatcaacgcttcctcttcttcttcgacttcttgagtttcagtagctttcttcttctcttcttcgattgccttttcggactcgatttgttccttggtctttctgactcttttaccgtaaacaaccttctttggttttggatgctcatcgccggatttttctagaccagcaaccttgatgttaccggcagccaatagagcagcacgtctgttttcaagcagtttcttttcctccttttgtttcttagttagaagtttaccctctgcctttaacttttcacgcttagcttgttctctctcacgcttagcctttctagcttcttccttttcttgttcagccttggccaacttttcttcttcttccttctccaatctctcttcttcttccctggccaacctttcttcttcttctagctgcttttgtaactccaattgacgtttcaaagcagcaagaccggctgggaccttcttctttggtgcagcctttggtgccgcaccttcagtggacttgccagcctccttttcagccttcagtttagaagtttgttcagcatgaagtttcttgttgttttccttctgcgcttgttgctgagccttcttctttgcggcttgttccctcttcttctccttctccttctccttcttttccttttccttttccttcttggacttcaagactggcttcttagtatcctcgtcttccttcttgtccagcttcttcttagatttcttcaaagtggacataaaatcttcctcaatggcagatgcatcggcaacttcggtttcaccacttggctcaacagaaccatctatcgagggttctactgaagattcttgaggaacatcttcctcatactcttcgtcccagtaattctgttgattcttctttgattttttcgccatcttgaactactctttcggatacaaaggttctacttttacagttcttccgaaatcttattatgatagacagcaaacaaagtgtaaaagagggttataacaagtaaagagataatgtaaaatccttttaattgatcttacgcaaaacaatctttcaaatagttttaagttgtgagaaaaacctgtactaaaaaataaaaaactgatgaaaaacttcaagttcatgattatacgtacctcgatggaaagaaaaaaataacatactagattaccctgtctttggtgaggtgcgcccaaaattcatctttcaggggccagaaaggtcccattagccttattttcggggtgaagaccggtcgatgccattcagcatcgctatttacgatcggcgttgaagatgtataaaatatcaccttggacggcttgaaaaaaattgacagcttcatctttgtcaacagtaggaagttctacagatattcacaatctcatcgcttaggattaatgatattagagtttcattatagtttggttacagaggccaaaatcagttaaacggttggaatcgataggtatcagtcagtattccactgaggttggcatcaaattataaaaaaaggatttattttgaagaatttcctgatcaatatctgaattgaaataaaagatgtctacgacagtagagaagattaaggccatcgaagatgagatggcccgtacccaaaagaataaggccacttcttttcatttgggtcagttgaaagctaagctagcgaaacttagaagagagttattgcaggctgcttcaagcggtagtggtggtggtgccggtgttggtttcgatgtggccaggaccggtgttgcttcagtcggatttgttgggttcccctcagtgggtaagagtactttactttctaagctgactggtacagaatctgaggctgctgagtacgagtttaccactttagttacggttccaggtgtcatcaaatataagggtgctaagattcaaatgttggatttgccgggtatcattgacggtgctaaagatggccgtggtcgtggtaaacaagttatcgctgtggccagaacttgtaatctactatttattgttttggacgttaataaaccattgcatcataaacaaatcattgaaaaggaattggaaggtgttggtatccgtttgaacaagcaacctccagacattttaatcaagaaaaaggaaaaaggtggtatctccattacaaatacagtaccattgacgcatctaggcccggacgaaattagagctgttatgagtgaatatagaatcaacagtgcggagcttgctttcagatgtgatgccaccgtcgatgatttgattgatgtacttgaagctccatcaagaaggtatatgccagctatttatgtgctaaacaagatagattctttgtcattagaagaattggaacttttatacagaattccaaatgcagttccaatctcttctggtaaggaatggaatttggatgaactactagaagttatgtgggatagactaaacttagtccgtgtttatactaagccaaagggtacgatgcctgatttcacagacccagtggtgttaaggtcggataggtgtaccgtaagagatttctgtaaccaaattcacaaatctttagttgaggacttcagaaatgctttagtgtacggcagcagtgtgaagcatcaacctcaatatgtggggcttaatcacacattagaagatgaagatgttgtcacaattttgaagaaatgaatacaggctactttttttttctcattcttctcaccgtcatcatagtttttagcattttcatcgcattttcatgtagtgttatccattttatttaacagctttccatagacggatctggttagattatcgtaaacgttcattactcaggttgccataacttctgttaaacattaactcaatactgatttgtcgtgttatgtttaaattcataaatagtagtaaatatatgatattttgtgaaatcgatagcaacggatacatatggcctttttatattggccaacatatatgttaagatataaaagcaatgatggatgctgatggtgatatggaaagaaagaatgaatgaatgaaacttcggttatttgacgaagtgaatattattctattagaaatgaatgtgaatagtattggtggaatcctcaaaatcacagcagtattttaatgaatccttttaaggtgcgatatagtacagcttgaattaacaaacaaggaaatctggaggaaaatgcagcctactgatgagagtgtattccattgaataacggataaattcgcagagaaataaatcccttatttatttaacgccattctttttagtcgtggagttgcgtattgccttgcgttgtatgcagaactgttatcaggctcaggagtttggaaatcagaagaataactgcagtcgctctcagaaaatggagttgatgctatagattccattgcatcattagcagcatctgaatatggtttatttccgaaagatatatctccatcttctgcctcatcctcctcaaactgctcgcgtctttttgtcgcaaagtttgttatttcagtcgaagagccgttggttgaccccggcctccacgtcagttctttggatttaacacgctcatggtaagccacgagaccgctacaccagtaaatgttatcctctttcatattgttaacggtaggtctcaagtttttaacgtaactaaaagcatccacaacattgatagatgggttctgtttgagcatatgactgatcaaaagaatcaccaaattctcatcattcccattcgaagagaagacaagaatgttccccatctttgcaagcttgaacaaggtaatcaaatcattgaaacattcaaacttgtgcacaccatcagcagtataaatattggtggtgtactccgaaacagacctgtacaaatgcgattgtagaggttgggcagcgcattcttctgatagagaaacgtgttgtataagcgttttcaagtccacagaatgcttattattgaattccaggatgttactcatggtatcatcactgaatctggtacggtcaaattctttatcgagacagcatatcataaattggtccaactgtatgttcctggcatactccattgcacgttcaacaggaataccaacactgatgaaaaacttgatatcattcttactcaagaagtcatactgtgataaagtgttcaagggtccgaagaacacattgttactcaactgttggggtttcatctggttcaacgtatgagccaatgcataattattatggtgagacatgtctagttgcttttttccataaagaatatcggaccacagattgtaagtagggtgaaagattgagacagagagcaaaacacaggctagttgttaccaatactcgaattatacaaatgaggttcaatgccagttagtaagctcactccgctcttgtcctgagtcaaagccttacgtgagtcgcattgatgaggttagtattcttttttgccaaaagatcaaaaatctgaaaaatagaaaaatgaatttttcaagctctaaaggcttattctagtaaagtaatggaaatggtgtaagctcggtcaaaggctttaatgctggtacaacggaggcggaatgagaacaaaaacaacgacaaaaatcagacaatcagataataatgtaaagctgaaagctgattgtaagtgcatgtttaattcgtcgaagcatcgtttgttttactgtatgcctttttttttttcattcctccattttcttgtgacgctttccaagacataaatgaaaggcgacactttgtgtaataaaagattcaccagtacaaagtgtttacttgtcagattttggcctgttgtccatcccttgacacagggtatttttacaaacataagctagtggtttaatagcaacgtatagcgtagatttgtaaccaacctaatttcgcagtaaaatgagaaaacaattgtctcatatagttaagtaggaaaggatagcttttgtaatatgataatcaaatgggaggtcggcatcgataaagagccggcagaccctggattaatagtatcatcaactccatttgtatctgataatgtgatcaatataactaatccccgatttagcaaatcagatataaaagaattgaaatggttacacaccgttcatcgatcagatatagcacaggataattatccggatttacccttagccgatcacacatctaacggatttgtgaataaccccggtttgctcaaggaaaacgagttttatccattggatcccatgaattgctggactcatgatcctgaatctgatccaaaattagcatattgctccatcatcttgcatgaagaagatgatccgatgttgtataagatagtaaaacacggtatgaaccacatacaaaaattgtatcagtatgagacacagcgaggaccatcatcactggctcgcaactcactgattgatagtacacatgccagtgatctagtgatcaactggaatcaggagttgaataatgaagaattttttgatttgggtgatttgacaataattgcatgtggtgaaattgctcacataaaaggtcagtcccatatgaaagatattgaaaatgtggaagtatacgtttgtaagctaaacctaaagtacaacgaggagcatttcattaggctcttgcaagtagaggatatcttgtttagcgggttacaatgggagttttttgcacatgacttgcggcttggtccatattccagcttagatattacgaaaagatttaagcgtagagcaactccatattctttagattacaatttactgtggttagatagagagatatttgtcgatcttctacaattcaggagtctaataattggtaagaatggagttgaccgtttctcagaaagccaagagaagtcagacgatacgttgagactcttgggttcaatgacagaatgcgaaactcgatcagatctggaccctgtgccatcagggaaggatgaagatttttacatgtcagatactgagatatcaagaatctttggtctcgacgtctctacaaagtcatctctatctgtggacgattcatgttacagcagaagagtctcacgaacagaaactcagcaaacaacgccagagaagacatatctacataatgacggtatgacaaacacatgtaacaatactaggtaaaaaatatatataaacaaaacacaggtaacattcaaaccactatactttagtatggtgtagttccgatcatattggttaaaaaagtcatatcatgatattatgtatcattatagagaagtaaaaagcatatttgagtctatcatattcgtgtctatcattaaaaagttgtttgatgaacgtttccaaaaaatcaggaccgttcaccagttctatcattaaagttcgtgtatattggccgaccctgttacgtaaagaaatatctgcaacagtgttttcatccatcctgtgtaaaaaaatcaatcattggtttgaggtattggctttaagttcattgatttcttttcttaatctttggacctctagctcgaatagtctttcgttgttttgtaggtatagaatgtaatcgacagccttttcgagaatcatactcttgttcagttttactttctttagaggcaaagaatcttctccagcactcaagactttattatcgacaacgaacgcagtatcttcgcaagccacccatgggataatcttttgtaattttccgatcttggtattaatatttattctgtatctcttctcgatcatgttgtgagttactctttgatctgccgtcaatctctttctggagcctctcttcttattttgaggtttctgagttgcacgcttctttggtttcttaacctcttctccatcttcgatcttcacttgcaaatcattatctatttcaactgaatccagggttggtaggtctgtactctcagcagctaaaggcagctgtgtaaattgattcttttcgaaatcaaatccgttgtcaggattagtagcgttcattaagggagagttttcctcagaaacgttattgccaatggtaaaggcagtagatgaatccaaagtatcttgattgtttaacaaaagatcggaatcaaacatagccctgtattgatccgatggtgataatgaataaacggaggaagaatcagaggtccaggtatgggtgtctacctctttaccagccttgtccaaccaaacatccgctgtaggtggagcgacaaaccaattctcaatattagaaccttgagtagcgaacatgttggtgttcttgtaaccttcttgctgctgttgttgttgaatagaagccattgtaatagtgtattatctgtgtatttgagtcctgttggtctatgaggacttaaggtataccagaagtatgtaaatatatatacaagaataaaatggaaacaatgtatgtagtaactaattatcaaactggtctatcaaatccaacgtggggctatatatgaaaaaagtagacttaaccatgctaatatatatgatttcaaacaaagacacacatatacaattatagaaccactatgcgtagaaaatagattaattaagcaaaagcaagaaaaatcagatttaatgataccactttcatacccaatacaaaaacaaaagcagatcttgactattctagctcaaagcggaacccataatcaccctctcatgtcctccccttttgcttcctaatgttacagcgacaagaagatatacattcttgctctacgtttgagaaaccagaagttgcgaaaaaaaagaaagcagtgggtgattaaagaagcatgccaaattaagagatatcgcactgcccgtaacataccgaaatatcacacgcacgggaaaattgaagacgacattttcaccactagtttcgtgcttatgttcggtaccacaatgcaaaccgacaacagaatatgcctgagtagtggacttcctccgtgcacacaagagataaaattaaatcaaaagaagactctagcaaggcgtgccataatccacgatagaatcctggaaatcgtcttacacttaaagtagtagtaactatacgtaaaatagccgttgccaatgggaatggaaatagcgcctgcgcaaattatgaggattttccggcgaccattccttatccaacagcgatgttccggctacagaagtatattagaaaaaaaattcctgcggctacattgtatgtgttgtaaaagaagaaaagagagaaagcaaaaaaagaccaacaaaaacttggcgaggggaaaggggaaaaacgtattatagttcacattccagcccattttcaaactggtcgttaggaaatacgtatgttagggtgcacccattctggaaacgctgcctatatctttcgtggacgggaagaggataaggaacgtttcatcttaactcctgccagcttccgctcatggacagtgtgtttttgggttcatccgtaggggaatggcaccacttagtgctctggcgtgcgttttaatcctgttcaacatgcttttcagtggaagggtgtgaaaagggccaaacatgcaatcgccgcagtagataaaacgtcggataaaccttacataggaagctcaatgaatgggaaaatattatgctcagaatgggaattttgcgtcaagatgcgtgggaagtggtgtggtttttcctactgagctttctactgagtatttccagctgctcatctcggaaaaactaagacaaaaaaaagaaaatagaagacgtacaaagtgctttgcggaaaaacattttgtttttctgctgcgtgtttgtctttggtttttgggttcagattcggataaacaaccgtcgtttattgcatgctttctatcgcttctacggcaaacctgtgcccctggtatatgtggcaccatacgtctcccaatagacacctttcaattttcatagcttagcgaggggttggatatcaacaacaataaccggactgtttatcttttttttattgatctaccggttcttttagaacgattacgtccaactggtcaacgtttttgtctttgtatggtgaaaatcttgaaaaaaaatccacttagaaaaaaaaaggaagcagtcaaacatttttccccctggaaccattttttgaagctttacaaaaagagtagtagaaaatatgggaagaggttgaatattactgtgatttgcttggtaacattggtttcccgtcgtgtctgtgcgtgtgtgtatatcggtcattgtctgatttcaataacttataaacaaagttagggaaaaatcgagactacgcggactctgaacagcggaggagttctacacatcaatatacggacacaaatgtacttctagaaagtaccttgctataacaatagtgtatctatcagattccagcccttgtgttatcaataatcagcttgagcatttattttccttttgtccttatctggtcattgacggagacttcagagttctggactggttttactcataactccgaatgccatgaacaataaagaggaggagcaagacgtaactgcaagtttcaacagaaatgaaccagatatagcatcctcctcgagtgttggatattcagggtatggagaatattttcataataaggaacttcaacagttggaaagtgatgttcaattcagacagaaatatcaaaaagaacatcgagtttcaaatcctacactttttcaagggtgtactatctatgtgaatggacgtacgaatccaactcgatttcaactccataaactaattattttacatggtgggactttcaagcattaccttagtgggaagactgcagtcacccatatacttgcaacagagttaaatgcatccaagaaatcatcttttgccaatttcaaggttgtcagccccgaatgggttactgagtctattgctcgagggaagcttttaccatggcaagactttagaattgtccaagtttccagattacagggaaagattacagatttcgcaacagtacggaactgtatggatccgaacttcattaatgcttttttcaaatcctcaagactacaccatttatcgaactggaaattccagttaagagataacttcgtgaaagaattcattttgtcatataacgacacaattcctgatcaaaaatatgtgtatttccacattgactttgattgcttctttgcccaagtgtctgctaaaatcgatggtaaatacgatatacatgccacacctatcgctatttctcatggtatcaacaattctgatatatccagctgcaattatgtggctcgttcttttggtgtttataacggtatgtgggtatcatctgctttgaaactatgcccggacttgaaaatattagattatgaatttgatgaatatgaagcaatttcaaatttattctacagcgctctaaaagatattggaatcttcaaaatggtattgccaatttctatagatgaagcaataggttgcatgttgattacccccgatattacctctgaattgttaactcaaaaatgcatgcaagtgagaaatgccgtctataatgttactcaaggatactctgtcagtgttgggtgcgggccatccgtattgctagctcgtttagccctaaggaaagggaaaccaaacgggttccatatttcttggtttgatactgttactgaatgccatgcattcatagatcactttaagttaaaagatcttcctggtattggttatagcacagatctgaaaataaaagaacaatttggaaatgttcaaaacatctctgacttaagagatcttttagaaaggccaagcaacgtttctaaactaataaaagtgattggttccaaaaataccaagaaacttcagatttaccttgatggtaaagatgacgacgaatccataagtatggtaaaggatcctcatacgtactttcaaaagaaatccctctcagtagaaataaattatgccataaggtttaagaccatagacgatgttgatattttccttgaacggctcgcactccatttatgggaaaaacttagggattcaaatttaatgacaagacaaataactttgaaattaatgaagagagctcaaggcgcacctgtagatccaccaaaattcatgggtatgggtaaatgtgacgctcttagtaaagtcagtaacttaggaactaatacacaaaaatttggtacaattgcttcggaatgtaaaactttatttagaatcttaagtgttcctccagaggaagttagaggaattggtattcaatttcacaggttaactgattcgaaccaaaaagtggggcaaaagtcggaacaaagggaaattacgactgatttatttagaaaacgagaccatccggatgatgacatcactaacgaaccctccaaagtagccgagccacatactccagttaacccaacatatacttctcccgtaaaaaactattgggatcgccatctaaagcgaagtatcaccccatttcaatatgactttcctgaccaactcgatcctgaatttatgtccaatttacccaaagatgttcaagaagagattacatctcatcataaggttgttaaaaaagccaatcgttctttgagaacaaaattgtacgatgatcccagaaagcaaattaagcagacgcaagatttacacttcatacacgatgggaggcttgttccgcagctttcgttccagggattaagttctgcgaaacagatttctgaaactcttatcgactgggtggacgccacagtggaggatggcccccatgaaaaagatcttgagttattcactagctatcttgataagttagcggagcaaggcagatgtcatattatactacatttgattaaaaccataaaaaatagggttgatgatcactacaacgcgaatcatgaaggtttagagcaatgggaatacttcttgattcgtcgactaattcctatattaaataaagcaaaacctgatgtgaagttcaacttagtgtttgatttataattgaatatccatctaatacttgttgggatgaaagcatgcatgatcattgcgcccaatttttttaattagtaattactctttccatgcactcatttgtttattaattattcatctttcgacacaacgtaagtataatagtagagtacaatctaattgtctttttctttacctaaaatatatatattaattagaaaatgtttgtctatggcttcataagttgcataatcaagtctaatggtgatcgacaagattttagtccaattttacccagtatcttaaacggtcaagacacgtagagtgttggagttaccgacaccagcggcgaaaccttgaatggtgacaatggtgtcaccgtcaaccaaaattccgaattccttggccttcttgacaccgaagttgattctcttttcaacatcgacagtccattcggagtcagaggattcatcgtatacgaatgggaagacacctctatatagatgagagaatctagcagctcttgggtttctagtaaccataacaattgggacatttggcttgtacttggcaaccaatcttggagtgtcaccggtggtggataggacaatcaaagctctggccttttgttcaaatacagcagaaacagaagcagcagcgatagtttcagtggttgaggttggctttggagtcaagtttcttaagtcatcgtaagttgggatgtatgggatggcttgttcagcaatcaaagcagtttcagccatggtcttaacggcattgattgggtagttacccttggcagtttcaccagacaacataacacagtcagcaccatcaagaacggcgttaccaacatcagagacttcagctctggttggtcttgggttgtaggtcatggattccaacatttgggtagcacagataactggcttaccagccaagttacacttagcaatcaacttcttttgcacagcaaacacttgaggagctggaatttcaatacccaaatcacctctagcaaccataacaccgtcagtgaccttcaagatatcgtcaaagttgttgacaccttgttggttttcaatcttaacaatgatcttgatatccttaccttgctcacccaaaacttctctgatagtcaaaacatcttgagcggttctgatgaaagaggcgaagaccatgtggacaccgttcttgacaccgaatttcaagtcagacttgtccttttcggacaaagctggcaaatcgacatcggtacctggcaagttgacacccttgtgagaacaaatcttaccggcgttcaaagacttaaccttcaaggtgttgtcatcaataacttccaaaacttcgaatgacaaaacaccatcatcgacgtagataattctaccagcttcaatgaccttggtgatgttcttgtaatcaacgtacatggttttgtcgtcacaagccttagcgtacttgtcatcagtagtgaagatcatttcgtggtttggaggaattgggtaatccacatcgttagtggtggtaccagttctgatttcaggacccttagtgtccaatgcaatagccagaggtctaccttggtatagttcttcagattttctggcgttgtcaatgacagattgatggtattcgtaagaaccgtgggagaagttcatacgaacaatgttcataccagcctttctcaattcaaccaaagtttctgggttgttggtctttggaccaatggtacaaataattgaggttcttctcaagttggtaccagtttcggtactcaaatcggtcaaccagcctaatctagattccattgtgaatttgtattaatttctgtttgtaatataggatgctgtttctggatcagtaaattaaactcaaatggtttgattaatttattgcacagaaagtatcaagtgaatgggtctgtatgaagtaaaaataaatctaaaggttcttttaacagtaactttgactttagtttagtttcggttcttaacggattatactgataaagaaaaacataactaaaacaatgatttaagagtagaatggaaaaccagctaacaacttcaattaaccctttttcaagtctctctttatatataaactttaccatcagcttacatcaaaaccaataagagaaaacccattgaaggacccaataaatttccatatccattgcatcctgatgggaacaaactcgcacggtgtctaactgatgatgagacttctgtaggaatccaaagaaaaacctgacattgtatggattagtgcatgatgtcgggcttctggtaattggaccaactcttgatgttttaggacgccgggctattggcttcttgtattcactctttctttgtgcacaaacttcctagcttccagttttccctcgagcttatccaggcggattccacaaattgtccccccaacatcttttttttttcagaaacatttttcttttcgttcctgtacttccatcatgagtgagtgaactgaaaaactggagctaaacagatggcaatggaattcgaacaaggtgacgacaaaaattgctaacggatcatagtatattctatgaaagtgcttcaatcagttgggataggaacgaacgcaggattgcgaaaaccgttattgttgaatcttgtcacgtgatagggatatcactatttttttaacttttggctctcagagtggaccgggtacattttttttgacactttctgtcgctaagccaactacagtccacgatggtattataaatcacgtgtgtaacttaaggatgagaatagttgaacaagatatgcatgaatagtggattttacggtgaactggatgatgtagaaaagacctgaagtattaatttacatatgaataagtttactactggagtgttaacaaaaaaaggtataatacgatttataaacaattggtttctctatcttagaataaccattccaagattttttcccagaggtttcttggtgggatacgtctagcattcaattccttggtttcttcttcgatttctcttagacccgtagtgacatcgatttcggacactgaaatcatccactggctccaagttctggtgtaagccttgtgacccaaccatagaatgaggaagagcggtagagtgatgtaggcagcgatgaaatccttgtaattccaatggacaaatgattcgtacccgttgatgagacagatgatcgcgatcaggatgatgtagaaccacgtgaagtatggttggaacggtgtcttaaacggaagtctgtcgtatagattgttgaagaagacggcttttctgaaacgtaagtaagcaacacctgaacagatccaaccaaggaaaccagaaatagttgagatgttagagaaccagttgaaaacatcagcggtggatgaggagacattcaagtacgctaggcaggaaaaggctgtagcgaacgcaacaccagtgtatggaacaccccacctgttgactctgttgaatatttttggtgcgtatccttcttgggatagagataacaaggatctagtggtagcatacatgaaggagttaccagaagaccaagcagaagagagaatacacacgttgataatgtgaggcaaaactttgatacctgcgttttgaataccaataacgaaaggagatgaaccagcacctggtttgccttgacttaacgcgttaagtaatacagggtcatttctcgacacaatgacacctgcacataatgaagacacacagtagaagaaaatcaatctccaaacaaatcttctggcagccttttcaatgtttcttcttgaatcttgtgcttcagtagaggtcaagacaaccaattctggacccaagataaatgcgaaacctgcacgaatgacaccggtaataatatcagaaagtcttcctgcaccgccatcggccaaatgatacgcccaagcacctggatccttccagaaacggaaacccaatctgtcatgatttggaccaccaccgaaaaataggacgatggagactataataatacccaagatacagaaaattttcaaagaacagaagatagcttccgatgtaccatagaattccacagcagtgcaattcaatacgacaataatacccaagaaaatagtaatccaagcagccttgggtacagctgtggtccaataagtgacgacaccggaggctgcggtacattctgcggcaacaagaataacataacaataaacgtagttccaaccgacagcgaagcctaaagatgaatccacatatcttgtacatagagtagagatagaaccaccagtttcattttcatcggggagacctggaaggaaacagaccatttcagctaaagcgttcataacaggatagatgatggttgacataatacagtaagagataaataaacctgcaggaccacatttgtaaagagtagaagaagtaccaacaaacaaaccagtacctatacagccaccaatagcaatcaattgaatatgagcagatttaagacctttctttaaattatggtctccgctttgaggtttatttggtagagaaccatttttttctgagtcgttcgagtaagatgttaaatctaactcataaacttgacctgtttgtttatccacaacactggtctcgccagcatcttttaggtcttgtagattcgacataattattgtagcttcgtattgttttcacgctgtgatgagcttcaattctgctataacgatgattatgatgattcaaacagttagttcgaggctttcgcgtttcttttttccaatttcttgaagttttacaacgttgattcggtatagcgggtcaaaactcaaaatgaacaggcctactagtgtgatgttgaatgatgtaaatattataataccagcctatgttcgcaaccaaagcagaatgatagttgcagtataggttaatcgacctttaacgtctgattatttatcgtcgttggaatatcggaaatcaatatgcacaagaccataacaagaaagagtcgtaaaataatttaagagggaataacccaactccacaaaatataacatcaaacaaacgacgatatatatacttaaatgtatggatttgagacaagtgaggaatactacattcggagaagggttctgcaaagatcagacatttgaggagaatcggtaatcagcaattaaaaaaaaacacattacgaatacatatcaagtatcggacgagaggtcagattaaaaagctatcattacactgctatcaatggatatctggatagcggaacagtaaggaagaacggctaatcggtgtttactcctcatctcatatctcgctcgcaaacaggtaaaatctcctttaatcaggatgagtagctgaatatgctccagaaatactaggaacaattaaactcatctcatcagaaaaacgcccctacaacaaccaaaacaagtcgtagtcagtcatatgtattcttcttacacgccattattatttgatcagaacatagaaaaaataaaaattcctgattattacaagagatacaaagtacttatcaaatgtcactatgtcaagtcccagtagctggattcccgcccctacaattacaccgtgaagtcaatcaaaacagaaaaagcgaccttcaaagccatacaaaaaccttcaggtttttttgcgccaaacacccactgataactagtatttcgttctctatatctttaatctcatctcatcgcattagcaatcccgccaactgggtttctcaagtggacaatctcccaaccaacaaagaaagcagagccttctttcaaagggccaactcgaggggcatcatttttcaaacttgtaaacaatgacgggtgcaaacgtttctaggaaataaggtgaaataatcccggcctcgagaatgacaggacgggaactgttagtttctttttgttttggtgagagtttttttcttttttgattttatttgacctcgcgcgcggaatcttctgtgtgagcaaaaaagagagatattccgaatgtatctgttgtggacggttgagtacgggattttcctactgcttttttttggagccgcgcgcactgtgcggaggctgaacgagttcagtgggacgaggaaacagtcacgtgtatgtaagatgccatagcacccatacctttttcccgttttttaatctttccgcaaacccctgttgtggtgtgtgggcgtcctggtcagcgggaaaccaattccggacgaaactcggcggatcttgttgtcaggtgaaaagactgggaggacatgaggaagtaagggcggacgagagaagctgcgggttacccgcacatacatttgtacccactgataaggattgactatcgtaatctatctatcggtcgttatcgagaagtactcactgtacatcgtccctgttttagtcccgcatcgtatcatttcccaatctttttggtttgaccacggagttttagagtgtgtataggacgtcaactaagacggatatcaagaccccctttgctatgttccgtttccgtctctgtgtcttttgcagcagtggcaggatagctctgcgaataacactgccgctttgacagcgaagtagctcgacaaggtttaggacgttaccctttagtgataaatggttaaatcgtaagtttttaaaaagaaaggtattgcaaatactgtattgatacaaagggtagaagtttgagtatgatgtgaactagtttagttttcgaatcttcttaggagctgtcgacaagtgtttttcagatgctcacaagcccgttaaagaactgaatgctcgacaaattaaagttgccttcgagaaaaaaagacattggttgcgcgttgcatcaaatatcgaagtcacgtgctcttgttgaccttatctctgcaggatgactcttcactaaaaaacgggcttcatgaatttgaaatcaatatatatatatagtatatgtaagtatgattctggtcagattaaaaccccaaatgagaacaattgggcttgtagtgaagcgtaaacagtatacggagcatcttcgccaaatcaaatttattcattgaaatgaacacagttcctttcggacatgagttcaaagcaaaatatttcacttacctggattcagaagtgactctactcaaccatggttcatttggtactacacctacgatggtattagatgcagccaagaagagtctcgaagaacatgagaagtacccttgcagagattacttcttgacttttatcgaagaatataagcgtcaattgcaattagtcgcgaagtaccttgatttggaatataaaaactgtgcctttgtgaccaacgccactacaggtgttaacactgtattgaggtcaattccattcaatttcagcaaagataaaattttgttccattccaccacctatggggcttgtgccaacactgtgaaatttttgcacgattacttcggattacagtacgatgttatcgatatcaactacccatgcggcaatgatgtgattgtgcaagatttcgaaaaacgtttgcaaactaaagaatataaggtgtgcctctttgatatgattacttctcaacctggcgcgacattaccttataaagaactaatccaattgtgtcgtaaatatgggacttggtctctggtcgatggtgcacatgctgcaggtcaagttgattttgcatttgttaatgaattgaaaccggactttctcacgactaacctacacaaatggctttcttgccctaaatctgtcgcgttgttatatgttgatccaaaacatcatgttatgattcagaccatccccatatctcataactatacagctcctgcatgccaatatgttgagggtgacgatggacataattctaacatccttgttaacaaatttgcctttatcggcaccgtttcgtactcgtcctattttgctgtggaggaagcattgaaattccgtaaggacatatgcggcggtgaagaaaagattcgagaatatcaatgggatttgcaagaagctgctattccaaagattttggaggtttttggccaaggatctgttctacttgaaaactcgactaattctttacgttcacccggattattctgtatagaattaccgattaaatcggaatgtcaacatctcattgaaaagatgagtactgatagaatttatttcctaaactttaagagtaaatgtgataagatcatgctcgcagagtataaatgttatgcgccattccaaattaacaacagtcacttgtttattagattttctgttcaggttttcaacgaacctagtgactatgaaaaaggtgctaccattatcaaagacatcatttacggagttttggaggaagaggcaaataataccaaacgcgatgaagtgaacagtcgcttagattcgttgttaatttgagattgcttttatgtaaaatttgactaacattgataatttatgcatcttctatgtcatcgctttccttcatagattttatattttaaattgacattggattttataatcttgatttgacaacaatgaaaaggaaaaaagtaaattcaatatcatctcaatttatagacatgatagataatctcaatactaccaatatcgattgtcattccaaacactttattgcattaaagagatcttcattacagtatctttatgccatattcttgttcacttctgatttttgaagagttttaaacacaattgctaggaaaagataaacccttttattgaaagcttgcaaaagacctcaagaatcccttctcccaccacaaccaagcataacactcgaatagtatgacatcaacagctcgactctctaaagacgtccttatacgaaagctgcaacatggcatgtccgatttcaccaatttcgaagagacaataggagtgcttcaactcttcgaggttgatcctctcatactcgagaaggctttgccttcattaattaatgaattgctttcgacatattttactaccaacactgataatcggctcaagattgcacggctcttttacgagtattcaaagatattcaaaaacaaaaggatacgggtacagattcccatcaagatttatgatctgtcgaaagttttagcgctattgaagtcttctcaagattggcattctcagtatttactaattacatggctcgctatgctcgtaatctctcctttcaaatttgataatgatactgaaatccttttgattgtatcgaagttcaatcatatggctcttatgagacccttaatttctaacattaaggctgagctttggtcaaaaaactacgcattgattgaactacctgaaaaaatttcacaagtagaccccatagatctcagctacatgttaaaaactttgaagcacaaaacaacatatcccttcagcattgaacaattgatagagtttacgcaatatatcacatctctcacttcatttgataaagaaattgatgctctgtatacgttgcaattacttccgcattttgttactgttctagcaaacagagatgagacctactcttgtatttatgatattttgttctggatgacctccacaatcaatctttctttcactgacctacgattcaaattggctaaatctgtttcgaaaatagtcctctttgtctctaatattgatgaagaaagcagtgaaatgataataactgactgtgttaatgatactgaagcattgttaaaaacaaattcaaacgaatcgatggactcagacagacttcatacatttttactgattcaagcagaattttgcaggagccgacttttaacgatatctcatatcagaaaattcacgcagagtatacttccagtaattagcaaatttcaacagaagagaatgatgagcacgcaaggacatcaaataagagatgcagctaattttttttgctggagtgcattcagaagttatacgaatattgagcttcagtctctcaaaaatatgttcctcaacctattatttacagcaaactttgaccattcaccattgataagaaaatctgctatggcagctcttcaagaatgtctaggaaggcaaggaaacgtcctactagataatgtgacggttcttcgacttgcagagatgcactttggtcagctgtcgaatgcactaactctttttgagttgttcaatggaagatatgaaagttatattgatgaaatggtacagtggctagttctttatagcgttggacagaactacgattatcaattcgttgaaaaggccacttccctactttcagagatgacatcccaaatcaatgaaaaatccctttctaatatggtttcaaagtatatcaatgaaatatctgtgaagggattgaaatatcaggaccctgacatatgtgcaagaagtgtttatctacaatgcaaaattgacactgaaagtctcctgaaaagttcagacgttcttgcaattttgcaccaacagaaaatccccaaagtttggaatgaccagatttcctttcaggcattagctgagttgggaggtatttgttcattagttttggatggttctttactctcaaaacagcaggtagaacggatttttctaattgcaagacatgctcagatgaatcattcaaattatgacgatatttcgaaactattgaatcaactagtatcttttatttccgcagatagcgaaccttttgatgattcatccacagaatgctcattttgggctatattctatcagttattcagacttcaacaacctctcatctgctgcgctgcaccgtttttgtcacagaaccaatttatttccttgttttatgattcggtttccaaaatgtcttgtgagtataagggaaaaatgattgattctctttctcaggctatctctagatattctcctgatgaacatcttcagatattccttcaagatgttgtattattcttggacgactataccactacagacaaaggagatgttggccgcttgactaggctttccacagtgaacttgattctaaaacatagcatgttatttagaaagttgacttgtctcccattcattgaaaactcattattaagattaacgggagagccctctacggaaatcagactaaaatgcttcgaagcgttatgtactcttcgacatgtttcccttgagaaccctccttgcaattttaatgcaatccgactttataatctacactatagggggaacaacgaattctggaaagggtactttttttcggctggggcaattcattcgaccgatagactaatctcttccgcaatcgacgatcttcttacttattaccaaggccttgaattggctgaccgattattgcaattgaatgagtttgctcggattgttccatccgccaaagaattcgaggagctgaaagcatccaaaatgcgtaacaatatactgggaaccataccgagagagatcataaagtcaactatcacatttcttaactgctggtgtcggatgctagaatctggaataactctcgaagaagattttaactatagcggtttttttgcccgtgtgtacaatcttcaacttgctgcaaggtcagtatctgtcaccagttatgctttcaggctattaacccttcttgtctgccatcagatacttaatgtcaggaaaaactcagcacaatttgcgaataccttcatcaaaatactattaaaacaattagccgcagccaaacaaagaaccgaattttccagtattcaaaacgttgctttggaatctctaactcatatctacatatgtgctgacaggaataaaaaaattgaacttatacaagaaaactccacaactccgcagcagttctctgctctaaaaaacactgatcttttaatctagaagattacttccggacaggtgcagcattattggaatctgtacacgtttcttcgataatacgaagaagattctctaaacgaactctatcatttttatcctgtctgatattatagacgtttctggcagaagacccgttcttggccaggtacctcatttcaagttcctcaatacgctcaacagagcattcagggacaaaattttctaccatcgctgttcgcataacttcatgagaaagttcagcattaagcccattttcctcaaagaattttataagcgtagactgaatattaataacggaatgccctaatttatctgcagcagtagataaaaacatgctaatgtttgtcggaaaacaaaattcgtaagtggaaccatcacttttaagaaaacttttacaatgctgcttcaaaaaatggtagtaatagtagtaaaattcttcgtgtgtatgacctttaagggaattgttcaaaagcacagagtagtcgaatggcattaattccacagaatcggcaatctttttctgtaagaagttgaagagcaataaactggcagttttatgcgtcggtttattgctcgacattgcaggaaaaaatgcatggaagttcgaataacgagccttattagttgcattcgctacgaaaaggagcaccatctcccggtcagaaaaagcgctttccaaaaattcaataaaacattgaaaaccctgaccactggcatgttttataaataacccaaaaatgtcacatttcatcttttgattgaaattcggttttaccacacttttgaaaaatgagtaataatccctgccctgttgaagaggtggtattttggagattaaaaagtccaaattcatctcatactgtgaaaggtcaacattagaattgtttaatatagccaataccaattccatattggaatcttcgacatcgttaagggagagggtgttatgcaacggtgcataagagtcaggatataattccaaaagaagtttgttagtttgttttagcatatttcgatcaataaatgctctgaaatctgtaatggtgtctggtcttaatttaaaccccatatccgagtacttttttagtccaagattagctgtagtttcatccccagatatgagaaaccgctcaacaaagcgctcgagttcatattgaacaatgaacaaaggtaccaattcagtgttttggatgtggttcctgtaataagctatcagtttggtacgttggtcggtttcttgataaaatcttagcattgtcatatgttttacggtatgccactgaactgcagccatgtttggaaaacttgtcagaactatttccaaggccgctttaatcatcaatagtgatctgcccttagtaatcatcgttagagtccggagtagaaaggatatggaaggagatatggtattaattttagtacagtatttttgtaacaaatgaaggttgtattttgaaatagcagtgagttcttgattatttagacgattactcgtcatggacatcatcatcttattgaaaacaaagtagagctcttccggaatacctgcttcgtctttatacaacgtctcgcctgggggtttgatccattcaattttatttgtttttaggaggctcaacatatggaaagcctgtttaaatttacgctctctaagtagcacatccatatacgaagaaacagctggtaaccatagtatgtcctttcgagcaccgccattctttcccgagtctttataccatgtagagttcaaaaaagctcttgtggaatcattaagtagcttactggacccacgatctcgcaataactcttcatccaaggtttctcttaacaaagagagatatgattgatcgtatgaagaagaagcaactttttgtttagagatcgcactgcttattgattttaccttattcatgacgcaaatgcacaaacctcacacaacaaatttggtaaacagtaatgttttgctggctgagggcttacaattgtgtaaaaaataagtcgaatgttagtgaagatggcagtgaaaagaaacaaagagcggctcagtgcaatacaaaaagcataactggaaagtgccttaattctttggatgtcgtcttaagttaattttttttgtattgccaactgtatttgatatatgagagaaaaacaaaaaaaaatgaaagcgatgagcatagaaaatattggacggataaatcaagaaacaaaacactatgacacgaaaagagcgtgtaacaaagagagtatcttcaccaatggcactttatgtatatataaacaaacagattcaaagctgaccaactttttaatagcagcgtcacattaaatattgtttgaaaaaagtttcaatcgtttgttagggtttttttcgggggaaagtttgacacttttcggtagtttatgttttacaacagcaaaggtatcaatgttctcatcaatttttatgcaatcagagcttaactgtaaaactttctttttgtatattctttccaattgactagtatgtttttccacccaaacctgatgtaaagcttcttccacatcacatctattaaaagtagaaacttgtagacatttcttaacaaaactcttggcactatctgtgatagcaatccattgtctagcagtaaaatttagttttccagttctaacatttttgatgatgcttgcttcagatccatcaccataaaaaggggaaatcccagtgagcatgatgtgtgttatgacgccgagggaccaaatatcgcacttggaatcatagccgttgttgtctggatctaaggtagcagttctactgaacgatcgataaatattacgatcggctttgaatcccacttctggtgcacaatattccggagtaccgaccacagtatgcattctttcttttgtattttgagataattcttttgcaataccaaaatctgcaagaacaaccttagtacatggttctggggtatgcaagaggatattgtccaacttcaaatccctgtgaacgatgccgtttgaatgtaagaacttcaaagctaagagaatctgatatatgattatcaacgattctgtttcagaaatcggaactaagcaatcgccttttgccaaataagagaagagatcacctcccgatataagatcctgaaaaatgtatacattgccaagggcatcaacacaagattgatgaatacgaataatatttggatgattcaatttttcaagaatggtggcttctttcaccatcctagtctttgcagtgttgataacttttacagcatatgaaacagtctttttagcaacttgtcttttcatattgtggtccactttttctgctaccaagacatgtccaaaagttcctgagcccactatacgcggcacaattttccatcgatcccattccgatttaattctcaacccagtcataaactgtgacatcgtttcgcttttcactgcagagaacttaaattttgccccgtttggtaattgaatcacgtcttggttggataacaagtatgggacgtctctggataagacctgctcattgaccatcgtcccattcaatgacatatcctttatgtagcaaagtggaacgctctcgggatcaaatctgatgccccatagcacacagtgaatgttcgaaacagaaggatgttcaacagagtaaatacactcctcagtgttccgtccaagtttcaataccttattaatttcaatttggaaatgatttacgatgaactgcggcgaggagtccagctcgctctccaaatcgacttccaatactcccaaaactttgtccatttttttagcctccgtctatccaatatagtgggaactattccaacagagggagaagtggctaatgaggctcctcttaaggatctgagactgccatgctgtatgtttatatagatgccagatgtgcgcggctaaaatgaaacgacaaaaaagcgaatattaagaaaacaaacaaccaattcattacccggcaagcaaagaagaatggcccacgtgaaacaaaattgcaatccgatgacataatcacaatatgcaccacgtgactctaagatcctcttgagcacaattcaaaagaaacacataccgcaagtaaccccacttcccatatcgttcaacgtcctctccaacctctatcctctacatgcaagcacaggcgctcaaacaccaccatgttgctcgctaacaacttctaaccctctcataacccttcattaattgtcactgggaacgttccagtcagcaatgtttgcctgaacttcccctctgtatttcgaaaaagtactcacgaactctacgtactccattcatcacggccctcgaagaagcttttttccctgcaaaacagtaaagaaagaaaaagaaaaagccatgaaaaactattatgggaattactcacagtcaagttctggcgatacttttttctggcgatgctgaaatattgaaaaactgaaaaattctgaatcgagtgaaaaatttcggcaaaaagacgtgatgtgatgagccatgtcttatatatatatatatgcaccagaacagtctttgtctggtgagattttaggacacggagtttgtgcagttgattcataggatagctatttaggggagacattaagctactgttccaaaggtgatacgaccaggcaaccataccccatattgagtatgatattcaggaacaccgttgtgcgtttagcacaggctgggaaaaaagctattcctccagtgaaactagcgtacaagaatatgctaaaagatccatcgacgaaatatagaccatacccacagatcaacttggaaaatagacaatggccttcgaagaccatcaccaaggctcctaggtggctttctaccgatctaagagacgggaatcaatctttaccagatcctatgtctgtcgagcagaagaaggaatatttccataagttgattgagattggtttcaaagaaattgaggtctcattcccatctgcgtcgcaaacagatttcgacttcacaagatacgctgttgaaaacgccccagaagatgtttccattcaatgtcttgttcaatcgagagaacatttgattagaagaacagttgaagctttgcatggtgctaagaaagccaccatccatacgtatttggccacctccgacatgttccgtgacattgtgttcaacatgtcccaagaagaagctattgctaaagctgtggaagccaccaagttagttaggaaattgaccaaggatgatccttcgcaaagtgctacacaatggacttaccagttctctccagaatgtttcagtgatacacctgtagaatttgctgttgagatctgtgaagccgtaaaggctgcttgggaaccaactgaggaaaacccaatcattttcaacctacctgctaccgtcgaagtcgctactccaaacatttacgctgatcaaattgaatacttttcaactcacatatctgaacgtgaaaaggtctgtatctccacacatgcgcacaacgaccgtggctgtggtgttgctgcttctgaactaggtattttggctggtgctgaccgtgtcgaaggttgtttattcggtaatggtgaacgtactggtaacgttgacttggttactgtcgcattgaacatgtacactcaaggtgtttctccagaattagacttatctgatattaactcagtcattgaagtagtggaaagatgtaacaagattgcagtttcaccaagagccccatatggtggtgacttggtcgtttgtgctttcagtggttctcatcaagatgctatcaaaaagggtttcaatcttcaagaaaagagacgtagtcaaggtgatactctatggaaaattccatacttgccattggatccaaaggatatcggtagagactacgaagctgtcatccgtgtcaactctcaatctggtaaggggggtgccgcttgggttgtcttgagatctttgggcctagatttgccaagaaacttgcaaattgaattttccactcaagtgcaagaaaaggctgatgctctaggtaaggaactaaaggcaaacgaaattgtcagcaccttcaagtcgttatacaacctcgatggaagcgcctccaacatttctttgttagaatacaatgtttctaaagtacagggtgatcagaagagttttgttggtcaagtccagatcgacaacgaagtcgtcggcattgaaggtctcggaaacggtccaatttcctctctaatcgatgcgttgtcaaatttgctcggtgttaaacttggtgttgccaactacaccgaacattccttaggatctggttcttcaacaaaggctgcttcttacgtgcatattgcttacagaagagaaattgacaacgaaaaggcctaccaatggggtattggtatgtctgaagatgttggagaggcttctgccaaagccatcctttctgctgttaataacttgatcaaaaagggcgaactaacaataccagctcatcgtgactcagcctcagcatctgcatagtcagcggagtttatacttttcaaaagttccacaaacttgcactgtatctaccgaggtaaaatactacttatttattcgttgtatttgcgacttcgtttaccatcattttgtatttctcttcttgacaattcatttatcagtgttacaccgaagactttgaattgtctttatattatataatttatattcaattaatatcaggaatatcaccacactcaccgtatataacattgacatcatggtatatattcaaggttggaaaaattgatgtggctcttcattgcgtacattcaacatgcctttcaactgatcttctcatagtaaaaggggtcgaggtaatagtaaagaaaagtcaaaaaaaaaaagctgatcataatagaaatattgatttgattaaagatcacaagacgaaatgatagagacaataaaactgcaagtagaaacaccagatttactcttgtatcactaacaggaccacctacattgcactttgggttgaaatgcagattttagtacagcaaggtcccgagagagtaatagcactcgcttctgaaagctttgcattgttgttgaaatatgtcccaccgaaggataagacacatccggtgtgtaccattgagatggttcccaagagctatttgaagaagcagaaatttgaaaaattgagcaagcttgaaatccatggcttcattgggttaattgagttggaaggaagtattttcataggtacaattactggaaaatctgaggttgccagcccaatcccgggagaaacagtcaacaaaatctatggagttgatttcttctgtctagatagtaatcgatgggatttcgttgagttcgattctaacggatttccaatcataccagaagaagaatatgcaagctcttccaatcaacagcaacagcacccgtgccatgatttgaagaaattactatcgaacggatcattctattatagttccgatttcgatctaacatctttactacagtctagaggtctcaaccagcattcgttatccttcgataattaccaagaagagtacatgtggaattcctttttaatgcaagaaatcatcacatttagaaaccatttggacgataaagccaagcaaataatggatgatgaaggattcttaacgacagtgatcagaggttttgctgaaactttcccatcatatatcggcagaatgcccgtcaatttaactatgatatcaaaacaatcttggaaaagagcgggaacaagatttaatgttagaggtattgatgacgaggcaaatgtagcaaacttttgtgaaactgaatttattatgtattcagaggaatactgctttgctgtgacagaaattagaggaagtgtacctgttttctgggaacaagatacagctctaatcaatccaaaggttacaattaccagatctgtcgaggcaacgcaatcgaccttcgatgagcactttaagagattaatacaaaaatacggccctgttcatgtagtaaatttattatcaacgaaatcttccgaaatagaactaacgagacgatacagagagcatttcgagcgttcaaaaagcctcaaattaaactctgaaatttttttaactgagtttgactttcacaaagagaccaaagaagaaggatttgctgctgcatcaaaaatcatgcctacattagagcgctctattctggaaaatggttatttctcatacgatgttaaagagaaaaaacaattgtctgagcaaaatggtgttttcagaacaaactgtttagattgcttagacagaaccaatctaattcagcagtttatttcaagatatacatttatcttgtttttagaagatttccaattaatcaaaccaaaacttccattaatcgaagaatatgattggtatcaaaaacacaataatatctgggctgatcacggtgatgcagtttctcaaatttatacaggaacgaatgcattaaaatcatcattttcaagaaaaggtaaaatgtcatttgctggtgctctctctgatgcaacaaagtccgtcagtagaatgtacatcaataactttatggacaaaaataaacagatgaacatcgacgcattgttgggccgtctaccacatcagcattctgtcgaattattcgatccgatcaatgactacgttaatgaagaacttagaaaacaagaagcacagtttactaccactagtaacattaagatcttatgtggcacattcaacgtaaatggactcaccaagtctgtagatttatcagaatggctataccctattggcaaaagatatcttcctgacattgttgtactgggtttgcaagaagtaattgaattgaatgcgtcttcgattttgaacgttgatacttcaaagtcacaattttggaaagacttagttcatagttgcttgaacaaacatgaaaattatatcatgttgagagccgagcaaatgtcatctttgattatattattctttgtcaaagctgacaaagttggaaatgtaaaaagagtagagggttcttcaaagaaaacaggtctaggaggaatgaccggtaacaaaggtgctgttgccattagattcgactatggaagtacatctttctgcttcatcaatgctcatttatctgctggcgtgaataatgtagaggaacgtagaagtgattatgagagtataaccaagggaattagtttcagcaggtcaaaaagaattgatcaccataattccactttctggctcggtgatttaaattataggattgagttgccaaacgaaaaggtaaggagtatcctctcattacctgataatgctgatttggataaattgctggagcatgaccagctgacatcggaaatggcttcagaatctgtcttcaaaggtttcatggaaccatcaattcagtttagaccaacgtacaagtacgatcatggtacagacagatacgatacttccgaaaaagctagaattccatcatggacggatagaatcttatacaaaggtgaaaacttacaaccaatggcgtatagtgatgccaaattgaatttgagtgatcacaaacctgtttatgcagcttacaaagccaaggtcaaatttattgacgaagaatcaaagatacaaatgaccaagaaactatatatggactacaaacaatcacatcctcaagattccggttctatcaatagtgcattgcttgatcttgagctagttgacgcgaaggaggagcctaaaccggtgatttcgacagaaatgagtctgttagatctggatctacatttcgaatctgccggagtgagcacaagccgggcgatgccgccaaaaccactatcaccttcttcaagatcttcatcctcaatgagtagtctatctttgactagtccaccagttggaccaactgccagaaggggcgataccgtaagaaatggtgctcaactaacaaaagaaccggaagccgtaagaagagtgcctccaccccctccacacaagaaaccagtcataacattggattctcctgttcgaacgccgtccccctcatcaatatccacgtcagcttcggatcgaaaaatcaccctggttccaccacctccaccttccagaaagcctaaccctccacctggtttctctgatgtcatattaactccaaagggatccactcctgagcctgtagcatcacctccagtacccatagatactgccgaatcatctgcaaagaaatcaaaacctcatgttccttcaaagaaacctgaactagcaatgtccctggattcttggaaaccacttcaaccaaaatagttcaccccaacgacgccctctcttcttcaatactatcataaaagttataaatatacaactaatttatgtacataataaaaaacttagaaacatcacatttatggcgattgacctcctactgatattctacttgtaggactgcggtactgtcatataatatcttcgtttttgtttattcaacatccaccgatcatgttgacatgaaaaattcaaggctttcccatttaatatatatttgaaaaatctgtggagagtggtactatttgaacttatcaactgaatataggtgacgtagccatcaaccacatgccaatcggacatgcttcactgaacatagcaaccaagagagcgtatattcagttgccatctcctccaccagagccagttaaaagagtaaaatacgaagataatgtgctgtttgaaattaaaccagaatcgactttttaccaagtaatatatagagagatcagattgggaaacgagagatctgaaaagttcaaagaatattacaaaacagaacgctgcacgatgaataattacaaaggtgaacatattttggcagtatttttcaaaccgcattataatttcctgcaacttgtgatgcattgcctgagagatgtgccaatattcgtaattggcatcactaatggcgatgagcgatgtctggaaaatttacaaatacctatgattaccaacggtaagaatattatcaacaagatgaaaatgttggatccacttggtggtggaatgtaccctcttgattgttgtgtactgtttgacaatttgggttacgtgcagaataccatctcttggcaaaacagtggtcatgatgcaagggccttcagaaagtatttattagatgtagtgacagatcgcgatataatcatgcatttggatccatagcttccttcagtttttgttcatatacctttatttccttgtcaattttcttggtcccaatgtgaattcgatcaatctcctcttgctcaagttgtctggagaacacacaggtcggagttttgttcgagggaaataagtttcctggtttgctcattagaagctggaagaactgttccactggttcattgaaaactatttcatcaaagtatactgcttttacctcatcttcgggtacttctgactcgtcattagatctttctatttccttcgtctctgggttaatgtatggatgtaacctcaagtggtgataaaagtttaacattttctcattagatacatctgcgaaataaatctttatgttaatttcaaattcgccccatccagtttctgtcaactcgaatggtggtgcttctattactcttacagggtttgggtatgtctcatgtagcttgaatacaactttcttgatgaaatatgagatatcttcacctctgggatctctgacaaatatggtccatagatgggtatgatcttttggggcattcggaggaatgttatcacccattttcttggctgtattaccataaatgatcggtctcgttacggataacgtttttatcctttttgtcaccggtggagctggcatgttaatgtgttttggatatgactataggaaagaaaggaaaaaacgcacacgcacacacaaaacaaacacgctaaacgttgttcgaaactttcaactaggcaacgatctgtagataatacaaggctaccaatgggtccctagctttgctcttaccacttttcatccataaaagtgaatatcctgacccacataggtttgatgatgaaatgaaaatcgaaactgcatatctacctaaaaagacacaacctgatgaatttgtatataagttaggaaacagtatttttaggcatgaaaaacatatagaacagaagtagcatcaataggtctaccagagctacccaagagctccaacaagacaacaatgacattaaaaacgatttacattgcaagacatggttatagatcgaattggctgcctacaccaccagcacacccggcaccacctaccggtgtaaatagcgatgttcctttagcttcacatggtgtagaccaagctaaagaactcgcgcactatttgatatctattgataaccaaccgcaaatgatattttcttctccgttataccgttgcttacagaccagtgaaccagctgcagatcttttagaacttctgatttatatcgatagaggtttgagtgaatggtacaagccagatagagatgtgattccagagccagctacttttgatatcttgaataacttctttgcaggtaagttgaaaagtgactggccaaatagcgttattcctagccttaaaggtgagactgaagaagatatcttcaagagatgcagtaaattttggcccatattcgttaaagaattggaaaaacagttccctgaagttgaaactattctgttagtaactcatgcagccactaagatcgcattgggtatgacgctgttgaagttccataatgtcagagagtctctagatgaagatggtactgtgataagagctggcagctgttctttggacaaatacgaacttttagacgatgacgtagatgaagatgaaaacggcgatgagtctgtattacccttcgaacaaagacaatggaaattaacaatgaacggtaacacggagtttttaagcgcaggagaagaaatgcactgggatttcaaatctggattcgaagccgggtctgacgaagatatcaaagctaggcgaaagaaacaattggaggaacgcgggactacagctaacagtgaaaaggtaactgatacaaattcaagtgaagaatatgaacacgtctacgttagccttgatgttgataatcgtaattatcgtgaacggaatacggtacaaaatcaagctacattacagcactccggtttagagactgataaacctttgataaaaattggtgataacgtttacgagggtacttggaagaaatctcttggtaccgagttagcatttgctaaagagttaggcaatgttgggtccaaagagagtgagcaagacgcaggtaaccctgagcgcgtttacagagtcacagatagtatagatcttaacccaattcaacctatgtaagatatttatatatatatatatatatatatgtgtgtatatatatcaattatccggtaatagtgaatatttttttttgggttgatcacaaccagcatagagtatcgaaaggaagaacaagagcagtaggataggcaccaccactacaacgaaatatgaatccactgtcacaaaaattgactgataagtatgaaatcattctggcatcatcttctccacgaagatttgagattttaacggaacaaatgggatttgacaacataaaagtcatgaaacccagcttcgaggaagatcttgataaatccttgtatgtcaaaaggccaagcgattacgtccaagacacatgtaaggagaaggcaaagagcatactccaagaattgactccaggaagtaaatcgaaattggtattatgtgccgatacaattgtagtagaccacaccgatgagatctacgagaaacctgtagagaaagaaatccaactacgaaacctgctcagattcactcaatccgggaaaccgatgagggtcattaccgctgttactattatcatatacaacacaccacaagaatacagctttgattccttttatgaacagacggaggtatacttcgacagtaatatcccaaggtcgatagttgagatgtacgtggaaagcggtgacggcttacaagttgcgggtggtttcaaagtgcaaggtttcagtggctgtcttattaagaaggtcaacggtgattactacaacgtggtcggtctcccattaaatggtacatggaaacgcctatgcactttgatataaactatcaaatcacgtgatgaaaatggccatggcaacaatattacccgaactaagaatgaatcttaaaggaaaaagaaactaacaatgagtgccgggtaacataatttcctgcaatatgcgaaaatttgataatgaaagctcatcgcatcgcattgatctatcagtatatacctatgtaccattggaataaagagttgagtaactttgaaggagtgagcacatcgtcactttgtgggaatagtctacacatcagctatagatatataccgaaacattgcatatcgttgattacaaagttcgataagaataaagagacagttacaatggtaaaaagtttgaagtctaatcctacaagacaagccaagaaggaccaaccaaaggcttctaagaagcaagttaaggagacaaaggctttagagagtgaagatctagaagctgtctccgaaagcgacgaatctgacattgaagggttccaaagcgctagcgaaaatgaggctagtagtgatgctgggtctagtgaagaggaagaagaggaagaagaacaagatgaagaagaaggtgaacttggtgaaattgaattgaaacaaggtagccatactatcaagaagctagatccaaagaagcaaagtgaaaatgacaaagccaaggctaaggaagataagtcttctgatttatcaggaatcttgtacatctctagactaccccaagggttcaaagaacgtgagctatccaaatacttctcccagtttggtgatttgaaacaagttagactagcaagaaataagaagaccggaaattcaagacattacgctttcttagagtatattaacaaggatgatgctgttgttgcacaagaaagtatgaacaactatttgcttatgggccatctgctcaaggtcaaagtcttgcctaatggaagctcgattgataagctattcaggtacaagaagaaaccatttgtgactagtaaagttacaaaatcttccgctcaattaaagaaaactgctgatgaaaagcatgaagaaagaattgccaaactaaaggatgctggtattgactttaaatggtaagcttcattgtcctatcctccttctcctcagcacgccatgcacatgtatctctacagttcagcactacaaatacttttgtacttacacatcatgcatgtatcgtttttgtaaactagacactaaattctaataaaataaatcttagcatagggacatgcagctaccgtaatattccatcaatacctacctaaactacagagatttatgttatgtgcgatattcactccttaaaactgatgaaatctgcctaccagtttgaagcagagtcggatgatcgcatagttgattctcaataaggcgacaagcacaatccaagggcagcccgtacatttgcgtagttaagggctgagagagctctgtgaccccccgttttcaaggcgcttttgtttactgtgtatgcatgtatctcacggctgtatcggacaatttgtccatagaaagctcgtttgttggaactttttttcaccaacaaacgaagtcttctcgaatacgaaagtttgaaatttgaatcgataaaccgatccattctctggtaggaaagacagaatatatatatatatatatatattctgtctttctatattctatagttatccgtcatctgtctatcatagtttctgtctgctaccgtacaggttaatcgatctttaagaaataaatctcatatcataaggagaaatacacacttgaagagcacacgggcttacacacatattttaagatggctaaacttttaacgtataaagaggtttctgaacacaaaactgtcgatgacttgtggatgattatcgacgggaaagtatatgactgtaccaagtttgtagatgaacatccaggtggggatgagatcttagtcgatcttggtgggcaggatgccactggtccattcgaagacatcggtcactctgacgatgccatcaaattattggaaccaatgtacgttggtgatatcgatatcacatctgagccagttcttacccagactacagatatgtcttctgctgctactacgggaggagaaggtaatgggttaatgatcatcgcattgattgctgtgtttttggccattgcatactactacttcaaccaatgatgctggcaatttcatgcagctcaccagaccacttcctgtactttatttattcaacaatatggaaattgttatcgagatagatatatttgttttgtctttattggtttacatcgttccacatcatatcgaggagactatttgtaaagctatgtatattactaccgatacctgcgtgtgtgaatatccaatcagttcacatccaggggccttaataacctcaagaacgtaggaaaaacaaaggcattatttaatttaaattcaattcacatatatttatttatcttgagacatctttccaaaaacgatgcctatcacatcgccagatatttttcatttttcgtttcaacttttcaacgcttcaagtttaagtgtgtcaacaatgagaagatcaaggtttttatatacgtaccaaaacaagtgtttggcatcaaacagctgagaaaattcaacattgatatctctgttgtttctagctcgctgaattggaagtagtagggctttgctaagtgcgctctaaagggtttttgtgcgtacaagtaaatatggattacattttcaaatcgatatctaactttcaattgccttttactaccgatggtgtatctgttgtgaatatgccatttggtacgctggaaagtggaaccaggaaatcagattcattacctgttaccattcatacgtataaaactgaccaagtaccagctgtttttttaaagaaccatgttttgaaatgtaagatccttaagcttccgggtctagcgaaagtattagatgtcattgaaccatccacagataaagtctacatcatcaccgaaagaattactgctcttaactcattggattattttaacttcaatgaaaatgctttgaaacttggtatctatgaaatagcactgacgttgaacgttttacatcaacaaggcaagtcacttttcggtgcattgtgtttaggtaatgtctatgtcaacagtaaaggtgaatgggtattatatgcattggagctatcgaccagcttgaacgatacaaaccatttcacgtccaatatccagacctataacgatgttgtgaggggctatgacgattggcagttgggaaatgggtcagcttcaaacattgactccatacaactggcgaactttttcaataaacttttaacaaatagaatatcttccagctggaagccagtcatatcacagcttgcaaagggtcaaccaggtgctattggtaagcttatcagcaaaatgcagactgatgcagaaaatcctttgatatccatatacgataacctaaaggagattcatattaaggactcagcagataaagttatgatactttccaatatccaacaaaaaattactgccgatgatgcatcctttcaaaattgcacaccagggttcttggagtatttattgctaccggagttaattcaatgtctacaattacttgctgccacaaatcaaccgatatcaagtcaagtgccctttctcggcactatattccacctaacatgttctgatagtcccattatagccaatgaagacgttttccaaaaccagatcaaaccgttaatttttcaatctttcaatgtagccgacagacaggttaggttcttgctgttgttgcactttccgaaattcatgcagaaactatcagcttctgaggttgctgacaaaatattcccaacatttattcaaggtctatcagatacagatcaagttataaggttgcaaactttgaaaaacgtttcacacctcattggaaaaattactgaacgtcaactcaataacgatcttttacgtgtattagctaaaacacaagtggataaagatatcgggattagaacattaaccatattgattattacgaaaattgctcataaactcaacaaatcaaataatagatcaacaattctggccacagcattcacgaaatctttgaaagatccagaattgaagccgagattggctaccctttatggacttgaaataactctagatctgtttgatgctgaaactatcgctcagagaattttgacagtaatcggccctggcttgctagatcggaacaaacaagtccgcacaactgctaaaaaggttttccagatgtactgggataagttggaggaagaatctgcttcagtagttgaagaggataattcaacgttcattcacacagaagaattcgaaaaaatgatgaatgatgaggaagacggaaaactgattaatggatttatacagagtgtgaaattaagcactccgactcctacttcaacccctattattctcactgaagaaactgttgaggttgatccgtggaactcagcatttgatgacgaagagttcgacgacagctggaatgttgacgaacctcaaagccgtactacaaagactgatactgaagtgaaatcatttggctttaaagtcccggtgagtaaatcttggaatgacgatcttaacgaagagagcattgaaagtgaaactgccaggaaaccgttgacatctagaaggaaaccactaccgcgccaaaacaagccttcaatcttaggaaaagcaagtgcaaaaccatcaatcctaaccagaaataaatcatcatctcctattgtaacttccagcaaaaacatcaaaagcgcaaccaatattccatctaaaatgtcaaatcttgtcctcgatgatgacgatacagaggacggttggggtgatgattggtaggcagactctattaattcttaagtttatcaattagacaatagtaatgtacataaatatatagaataatattgttataatcagcaaccagcaaccagcagatagcaaatatataatgttttttaaagaacaaatcgcaaagacgttatacaaactaacgtctccagccttggtctctggatctgtttccaccgaagccgccacggccaccaccgtaaccaccaccaccgtaaccaccatcaccacggccaccaaagccacggccaccacggccaccaccaaagccacgaccaccacggccgccaccatatcttggatgttggccgtattgacccctgtcgtatcttcttagttcttctggaatatcttgtttagcttctctcataatcttgatcaaagcagcacccagagatttattgccttcagtgaagaaggagatggcagtaccagtagaaccggctctaccagttctaccaattctatgcacataatcttcgatgttgcctggcatatcgtaattgataacgtaattaatacccttgacgtctgttgaataagaatgaagttagtaagttcgttcgtaaatcgtaatggtaactatattgacagcacaagttcgaagcacttccaaatgagaatataaaatccagagggcgcaatcaacgatttattataacattagcccgcgcggcttattcatgtcagaatagtcggtggaagacaaagatttatgtaaggcttgcttatgtcgcaaatatgtacttttctttctaacttcatagaatacatggaacaactactaagaggaatcgcaaaaataaaactgaatgcacactttgcataacagggaaaccatcctgtgacgctattttatcagttttttaattctttaacctctttgttaaaatgaatgaatccttatttcattaggttcatgttccaatctactactaagcacaattaatgatacgcgaatctgatctaactcaaacgatcatgttaaaaataaagaacatctttcagcaaaattgcatcaaagagatgtcaaattgataacatgattagaaaaagtatcgaatgtccggtaattcatcacagccttcaatgcaacgagaaaaccacgttgtgtaaaagctacttcaccacacattcgaacccaacggtccaatcaaaacctgattgtcatgaatactagtaagcttgccaatctacttttaattctagagatctgaataaatcaaatcacatcggactggtcaagtctctaaatctttatcaataattgtggaagtcaaaatgaaaagtattttcatatccttttctctgtccgcaccaaatccaataggatttcgttgataaataataagaccagctcattattttttacctttgaatcgaaaacatccgtgtcattcgaataaaaaggcatatcgtgatcatttcgaaagaaatgacttcgacagttgtctaatatagttagtagaaaggtttgacgatagtctcaatgtaaactaaagttcaaaccaatgctgaaaaaattaaatttcaataacataccaatacctctagcagcaacatcagttgctaccatgataggagatctaccggacctaaactcagccaaaacccaatcacgctcgttctgagccttgtcaccgtgaatggccaaagctggccagccttcagttctcaaataagaagtgatctcatcacaagttctcttagtggaagcaaaaatgatgatcttggagtcttgatcttgagaagcggtttccaaatgcttggccaatctatctctcttttcgaaatcagtaaggacttcgacgatctgagtgattgtgtgggatgcagacaattccaaagaaccaatttgaacttgaattggatcatgcaaatagtcacttgccaattgtttaacttcctttggccaagtagcggaccacatcaaagtttgtctatcaggtctaatttgatcgacaatttttctgatttgaggttcgaaacccatatccaacattctatcagcttcatccaagacaaggtaagtgactcttttcaagtttgtcttaccaatttccaacatgtcaatcaatctacctggagtagcaatcaggatttctacacctctctgtaaatctctgatttgttgagactttggaacaccaccatagacacaagtgtttctaattctagaggaagcaccaaatttggaacattctttttgaatttgaacagctaattctctggttggagccaataccaaaacaattggaccatcacctggagatagcaaaggttgagcattaatatgaacgatacctggtaaacagtatgataaggtcttaccggaaccggtcgcagcgacaccaatcatatctctaccagacaaagccataggccaaccttggcattgaataccagttggtttggcgaaaccttcttgcttaacttcatccaagacataagatgggaaaccagcttcatcaaaacttctgataggttttggaacgtcatgaccagaaatggtcatttcgttttcctttctaaattcgataacttcactttcactcatttgagcaacatctggatgttcttggtaaaaattcttttcgaaaactggcaaatttggtagttcttcgtcccagtttggagcgaccaaatcaactctggtatcacgagatggaccacgaccaaagctacggccaccgcggaagtcattacctctgttgtagctgtttctgtcagaacctctgctaccacggaagtcaccatgagtgctgcccatgttgtttctgttaaattgatgatctcttccaccgccgaaactcattgttctctgtataatgtgtgaaataagttgcttgatgttgagaaccaaacgataaaaaaaaatgcacacttgtaatactgaatgaacgaggatcagagacaggtttgaataatgtttgcagcttatatattagtttcaaagggcgatgagggaacttgcaaatttttcaaaaagaaacaaaaaagagagaaaaagaaatttgtaccaatgtaccaatttaccaaaatggtcacgtgattacattagccactccagctacttttgccaatggtatatccaacggtgcttccaatgtgctagattaccagtagctataaacgtagaatcaatagatattatagtgtattatacaaggatgatgtagttgtgtatttaattctattctcttatatatagttaatgcgggagctggagataaccaatttctacatttccctgattctttgcgtgaatctgtcctctacagcatcacacatgtccattagatctccaagacccttgtgcaaagcctctacagcagtaattttgccgtatgtttgaattctaatgtgcaaaaagttttctgaaggatgaggaatagagtaaccacagaattctacctccgggtttttcatgatcatataacgaagcgtgttaccaagggtatgatcttcatctgttattctgaaagaagcactagtaccatcttcggaagtagcttctgtgagaagtttgatcttttcactgtccacttcttcctccacttgatcaacttgatcattttgttcagctgctagcatatcaacatcttgcttttccacttcagccatatttccgagagcgcttatgaatggtcacttaggtggtttgtgcgtacttctttcaaacagtcaataagacgagatgacctactctgttaagctgaacaatttgtcaatattgattatggttttttcgatagagagaagagggaaaaccaaatcatgctaaaggaaaaaacaaaaagcttacccggtcttgaccgggtaactgaaagaagcaagttgatgcgaaataccagatcacgtgtcacacacttcatcagttaccgcgcaatgcacaggtgttgctcatagccacgctcagggtaccacaccatagtatataaacaacggatcccgaacaaaaagcaaagtaaactaaaagaaatgagaaaatgcgaccaaagcgagacatacccaaagtcccttggcaaaaatcatcaggggaggccgttacagaattagcataacaatccgggtcaagtatcaaatatcattcacaaatcataaaacaaggacagtccgtatacctaaccagttatcagctaaagtttccatcatcacgtatagtgctgtttccaatctgttgaactaatatcatcattccacggaaaaccccttacaaaacaccgtacagacacgacaggatcaatcagttttccttctcccttcattcatcattgcatttttcaaaaaaaatacctataagaaggaaggtataaaaaaaagttttttctttttttttcaatcttggttttctcatcgttacattatcattttggaccaaagcccaaaaaatagttgttacttttgatatcagtttgttgttattggggcaatcaaaataacgatattgaatttcggtattggtactggtattattgaccattaacgtttaatatttcacaatttacccttgagatttggtgataggagatctgagtgttgcatctccgttttagtaataggtttcccgtgagattttccttttaaagcaacacgcgttacacgatgggcagcacagaaactcaaaacaatggtgctggtggtcagcgtcaagagcaagatagtgctcaaagcaaggataagatgcctcctcctcagggccaacccgtgaaccatccaaatactttgacttctttgaaccagccaccgggtagtggtcaaagacaggattctctttcaatgtatacgaatttcaatcagccaaggttgtctacggatagttcgatttcttcgtttttgaacattgataatcagccggataacagagggtctacttcacagatgggacaagtgcctagcaacacggggcaagagttaccctatactagagggttctccattgttaataacctttggaacgcgcctgcccctcatccgcagaacgatgtcgccttcactaccacaagaagacaatctgagcaattggaacccttcatgcccaagtttaatacatcaagtttctcgcaaccttcaaagggtttacagcagcaaaggcagcagtttcaacagccacagttgcaacagggacaacaatctcaatcagttcaacagcagcaatcccaacagcagcaacaacagcagttacagcaacaatatcaacagcagcaagctcagcaacaacatcaacaggcccagcaacagcaacagcaatcacaggcttcacaacatggccagcaatcacaattccaacagggaacacagaattcacaatcacagggccacctccaaggatctatcaataacgctcttggacgtccagaatcagtatcctcttcgaaaagaaactcgttgtatttccctacttctgatgcagatttagatttcttcaacacggggaaacgtaactctatcgcaatgaaaccaccattgatcaaaccaaacggtagcggacaaaatcaacaagttaatggtgcagacgatatggaagttccatttttccagggccctctatcgaggaagaattcgatcaaattcaacccggaggattttgctgatttccaattcaaaagaagggattcttctgtcagagctaccctggacaactcaaattacatgcctgctcctccaaagagaataaatgatggttctttgagccctatcgaacatcaaatggtagataatgaggacgttgaagatgtggaaacaaggttacataaacacttatattcattggtggataacgtgaaactggataaatcacctccaaagaagaaacaaaaagctactaagaaacagaaaaaggctactcagactggtaaaaaggtcaatgatgacgaacatcaacatcatcttgacaatgggcaaatgcaatcagacaacggagctcacatgcagtcgttgacacctctgaacaattccatatcatcgatggatgactctaagcctctattgggtgctactaaagttgatcaattaatgttagtgattcaagcgcgtaagaatggtgtcacggacaaagttccacgttctgctgatggttctctcttattggaatcagcaccttccatcataccacctctatcacaactagtaggtggtgttgaaaagccgaaatctaaaggcgttaaacaattccaatgtccatactgtcacaaatacttcactcaatccactcatcttgaggtccatgtaagatcgcacattggctataagccattctcatgtgaattttgcggtaaaagatttactcaaggtggtaacttgagaacgcacattcgtttacatacaggtgaaaaaccttatgagtgtgaaagatgtggtagaaagttttcacgtaagggcaacttggcagcgcataagttgacccatgacaatctgaaaccgttcgagtgtaagttggatgactgtaacaagaatttcacacaattaggtaatatgaaggcacatcaaaataggttccatttacaaaccttaaataggttgacacaaagattggcagaaatggatccaaacgagaacatttctcagaaggaacgtgaattgctagattactttgcttctatctacagaaacagtaatcgtggtattaagggaagaggtaagggtaatcaaaacattgttccgctgaactcgttcgacaagcaccaacagatggatgatcccagtgtcagagtagccgctaaggccttaggctccctgactcaatcaaagcaaccttcgccaatgacatacgaaacaacttcaaactcctctatacctgacaagaacaaccaattttcttttcaagacaatgaaactcaattggatgatgctgcatacgctgctacaggtgctcttggcttaggaagcaggaacaccaaaaccccttcacaaaaggagaaggttcacttcaaggacgtcaatttcatcagatagttaataactattgttaataccatgaactttcacgattttcaccccatgcactttcaaaaatgaaaatatttaaataaacgattcaaccccagcataatgaaagtaaattgccttcagtgatttctcaattccccagttgttttttaaaagctcaatttactctattcttcattcttcaatcctcatcacggcgatgtggtgaatatctcggacattatttctcttttttttgttaatttaacagttccccaggttattagttactagaatttttctaaataaataactctaaaaactttgtaatattttaaactcaaatctgtattcattgactctttttcagtgtacaaactaaaccctcatcacaggtgatacagcacattatcctgattcgtccttcccatatcccttctcgattatgaattttatcctgttatattgtatgttatttctcagtgccacgcgcatttttttttattttcgtgtaatgtaaataaatcaaaaaagatggattataggatatataccaacgtcgaactgagggtcaattatagatagacactgacgtatatttggtactttctaaaggtgttttatgtcgagcaatacattattgttaaagagcaaactcccagtacgaatacagcgacggtagctgcaagatacaatcagtacaatgttaaaaatgttaccgacttcgactcttcctgcaagattttctgtcctccaggtgaccaacaagaaatccttcaagagacttgatcagagaccactagatgtattccaatattatttacagctgcaaatcgacaggcttaatattattgctgattataaagatcataggagtcatattcctttggtgaggcgaataagggcagaatgggaatcattatcaatcacgaaaagaagggtttatcatgcgttgttcttcaaattcaataagatcgatttcagaaaattaggaaacgaagaactggcaaggtaccttgcaatatcgtgtcctatttcaagtgcatatcttttgtttcgctcaaaatataaactacagtttaatctaatttgggaacagaggtacataaaacaagaagaagctccaatgcaccgtcccacgtacttggaaagacatactccacttatgaaaataatatctcattcacagacaaaaatggattctatgcttaacgcacacctcaggtaccaagagatgtgtaaatcatgtaaaaaggtttggaaagaaaaagtcactgacgagcaaaagcagttgttgtacgacaagataaagagcagcaaggaacgtttcaatactgaaatgcaaattgaaagaaaagagttggtattattgacaaaagttttggaggactcagtcccagaagactccatggaatctctggctgactcgctctcgtaccataatttcgaacaaaagaaagaagtcaacaaccatttgctagtgtcccttccatacatacttcgaaagaaaaaataaaacataaactactcaaaatatcgcatatactgttcatatataaattgttgaataaaaatatcatataagctttgcatttcaaccaagcctctatcacctttcttacctaatcaatcctgattattctggaactgatttacttgaatgttaaagttaagaccctttggaaattggccaacaggcttctttttgtcttcaggaatatcgacataggtgaatgataccaagatatcatcttctggcaccccaagagaagtgaggattcctgagataactcctagcggcacctgtatatatggcgacacggtactcaataatttttcttcatcatcgtccaatgcaaaattttgaatcggttggaattcataatcgaaaagatagaacactccgcggtgattcgtcttcaaattatctatctgtttcccatacagcagtttccagacttccttgcatatgaatctaaccattcctaacgtgtccatcgagttaaatgaaagattcgggttattgctgaaaattagtaattctgtcatcttactgcctatgccgcttccaatcttgtataatctctcggtaactttttcctttacttcatcactggcatggcaaagttgggcgattagtttgtgagaaggtacatattccagtttattcaaggatagtttgtgtatttcttcatttatttcgtcagatgttggttcaacagactgcgaacttacgctggaattttcatctaactggcttaaattattctcaactgccattgacataggcaccatttcattgagtagccattggtatgaaagagcattgaccttcggtaacgattcttgaaataataaaaactgctctactattcttcgcctttctatctgttctggagtatctaccaccggatttctttgtggatttgaggatgacatctttttaacctggatcaatgattcagagagtatgtatacaaagcctttgcttgatgttcctaaggttgcttctaacctttaccttatacatataacctttttcttaacttgcgtatatgtgtcatttctgttctgccaaattcgatgttgaaattgattaatttcataatttgattgatctacaatcatcgatggaacgaataacatattacaaagtcatagaaaaagacgaagcaattcaaaactcgaggagtcgagtgtggtaataccatgagtgaatcgatatctgttggtaatgaaatcaaagagggttttcctgagaccaataaatgggttcaaaacaacgtcaaatggttatcgactgtggagtccttttaccatgaaagatctaagcttgaaaaggagtacagtgaaaaattacgtcaattgaccaaggaatactttgccaaaaaaagcgctgaaactgttgctttatctgttggtaattctccaactaccacacccggttctcttgaatgtgcatcacaagtggcttggaatgaagtcttgtctcaaactgaattaatagccaaagatcatgagaagttctcaaatgacattgcattccacatctgtgagcaattgaaaactttgacgaaccgatgcaatagcctagtgattagtgctgaaaagttgaatgctgaagtttctggaagaaagactacatgctatgaaaacttagagaaagctaagaagagatactacgattcttgtcaagttatggaaacagccagatcaaagagttctaaatccagctctgaaaaggcgcagagaaggcaagctgaaaaagagcatgaaatgaacatcagcaaaaatgactatctaactaaaatcaaccaagccaatagagtcaaggacaaatactttttccaagatgtgccagagatcttagatatccttcaagacatcaacgagtcgagggctgccatgttaaatataatatggaataaagcaggtgtcttagagagagaattgaataaaacaattgattcgagattggatgcagctgattcagtcatagccaaaaataaaccttatttggacacgtcaatgttcataaagcataacatgaaatcatggaaggaacccaaagattttctatacgaaccttcgagtgtatggcacgatgatgaacattttgttgttaactcccaggttgaattacaagatttgagagtgaaactagcgaaggctcaacagcaattgcaacaaactcagtatcacattgaatcagagaaaaaatcattgggacagttgaacactgacaaatgcaacttaaaagcccaggaacagtatgacccgatgcaatttcaagatattctaaaaaactacatttcctctgtttcaggtttcactgcattggagcataaaaagcttgaagctgaagtggaagctgaaagtattcaaaacaacgttgctgatgattcagtcttggacacctcagaagttgatctatctcaacctgaaaagaaacacgggcttttggggaaatttaaacagaacctgacaatatcgtctaccctcaacccaatagcgacgaaaacctcaacaaacaacaattctgatactatttcaatggtatctgcagaaacacaagcatccaagaagtcgaatagattctcaattttcaagaaagttggtcgctcaaagcgaactgaatcgaccccattcgatgatgactccgtatcagttgttccctccaatgcagaaagtttcacaccatctcaagaggtgtcatacaacaatgatgacactgtgaaaaacactcctactggaattagagccaaagtactctatagttatacgaaaagtgatgctgatgaagtatctgtcaatggagacactgtcgttactgtcttaaacaaagatgccggtaacggatggtcattaattaagttggatacaggcgaacagggcctggttcctgaaacctatattcagttacaacaaagtaccactccatcaactagtcgtgcaccaccaccaagggctccacaacctagaaagagtgctcaaaagactatgaccgcagcctatccataccagtctcagggtccagatgaactttccttacaggttggagataagatcaaggtattaaaggaagatgaaggaaacggctggacgtttggtgagctaaacgggacacagggcttgttccccaccacttactgctcctaatccttataaatagctcttgtgtatgaaaatttacgtttatatttccaatttcccattatcattatttctatgctgattttagattgtaaaagaggtgttccgttgcatgtccgatcctacctatctagacgcctaaggccgactgtagttattactgatgagatttgttctttgcatataaaccctgacatcgcacttattttgatgcaagactgatttctagtttttttagctacaggaagagttggttcaaccctttaaaaaacgaatttgggaaataaaggatacattagttattgataggctttgctaataggaacaagtagttgaaattttccgaggaactgacaacagagtaccattaatctcaacttgaatatttctatattgttggttcagaagggcgtttatggataaatcatctttttcggacagttcggtagtggctagtagcagttctataaaatcatccaataaacttggcaagattggtatgcaagaaggttctaattcgccaagaatgagtgcggttcaaaacaccgaggcgcgggattcatcagaagcttcctttgagcatgaaccattattagaaggacagagatcagggaaatcttcgcatcgtaccctaggagccgttgcaccgcaaccgatcaatgtctctaattcgtcgtcgcctggggatgatttttccgacgatgattccgaattgcccagggatccttctgatctcttgtacagtgtcagacgaggttatcgaaatttcatccataaatcaaagactcttttgaatattatgatattcatcaataccttgtggttagtgacaactttcatcagtgattttttcttcaacatcaactttttgagaaacagaataaccggtttccaggacttgactcttatttttgtttcaattgttgccaacagtttaactctatggtttaacaaaattggttattattcctctttggatcagtatttgaacgtggttctttgtggattgacattgttcaacttacttacaaatttacttgtgaaatacatccgtcaacgtatcgggttattaggagtgtgcacttatttatgggctgcagtatcgtttgctgttagtgctgtcatggatcgttatctatattacttcaatacaaagttccaccctaacaattacgatgacgctgaagcagataatgacgaaaattcaccgcatcctaacgaacatagtcacaagagcatcagaaatcgtcacaccctaaccgaatgggttagtattgggtttagaacaactgttaaaggtgtgttgttagtatttttcattttgttcacattaaacaatgttcttttctctcttgattccatattgaccactaagcaggtagcacaggtttcaactgaggcaaatgcagcaagctacgatgcattccattgggtagatgctgatcacaattatcaaattcatttaaagtgttatggtgacgtatttgatgcagaaggatccgaagacgacagacaacctattgttcttttcgaacatggaggggcagatacggcatttttgtctgccacatggattcaagaactttatcatttgaacagagttcaaagatattgtgtgtacgaaaggcctggttatggtctatccgattccccacctgcaccggtgtcaatttctatgatggcagatgctttgaaacacgtcttattgaaggaggcaaacattacgggccccttcactactgtagggtatgacatgggaggccttttcactcaagtattcacagctaagaacattgatttggtcgaaagcatgcttcttgttgaatcgtggcacccagatttgctattgaagaactacatttcaagattgttaccgggggatgacaatgatgatcctgatgattatagtaaattaccagatgagatcaatagacataacggattcgttatttggtggaagggtattttatcaacgttcaatattaagttacaaacctcttggttactagctcatcacggctcaaaagagagaatttatggtcgtgatatgatctatcaaggtaaatatttgcgaatcaaattcttggagagtgtaacgagctccttattgagttataaagatgtcttgaacagcttagaaaacctaagagaaataaaaatgagtgttgtaagcagtaatgagctaataaaaaagtctcctcaatggggaaactggcaaagggagttgtccaaaatttcatccaagacacaggaatggaaaatcgtcgatggagggcaccaaatctacaagtatgggcttggaaagcagcaagcacaggacgtccttttgagattgattggtgagaaagacagatactaaatgagaaacatatgtaacatcttaagtaatgtactcctcttttctaacataccagttttacttcccattacaaaccgctttaggtacatttataccatcacaatcaccgacgaggactacgttgtaagaaaaaaaaatacggaaaatactgaaagaattgaatatatatatatatatatgactatgatatatatgtgctttaagattaataactttcagaacatctgaaactggcctgttcagttgagcatgcgaatatcgccatcgacgtcgttacagtattcgtcttcctgttctggtattggtggatgtgttattctgctatctctgttcatactcggaaagaaagatgtgccctcatcattgattggggatagtctcgacctggtatcaagagtctcgttcggtgaataaacatcttcatctacaaattcctcatcttcatcttcatcgtcactatccaagtcggcctctaaatcacaaactgctctgcagttaggacaaacaaattgaggatatgtttttgatacaagttgtctaatgcacttgaaatgccaactatgtgaacaaggtgcaatgaaaaccgcttgacaagcttttattttagataaacaaatcgaacaatcctctaattccgtcccgctggtcatcttttgcaaggctttcatcttttgaatagcttctttattgaatgcattagctttccttctccaagatttattgagctccactctcattttaacacacctgtaaatttcttccgcaccaccccggaagtctaatccgagttgtaatatatcgccgtcctttaacagaaaatccttggacatagtagctggctgagaaagtctttgatgattcaagaacgtccctgatgatgatttgacatctttcacaaaccaatttccattatcgtcaactttgaaaacaccatgtgtccttgagacgactttactcttgaatacggctggatggaacggttcgggaatagaagaaatggcctctctgaccttttctgtgtaccttccgattaccaactgagaaccaggaccagcagttcttatgatcggatcaaaatagaaaccggggttaccagccgatgagttgtctataaatgcggtcaatcttaaagtgaataatccgtttttatccttacgatttctaacagtttcatcatctgcagcttccggctgggcccaatcaggtgcaaagtctagatgcaacgatggcgctgatgctggccttactgctgggtatatgaaatgatgaacgtttttcagagcttgaccgttttgagggatggtaccgtgtataggaggggaagtgagcgggatatgatgaatatcgtttgtgttattaccaccatttccattagtctcaatttgtcccaatacaagattgatcggtaaatgatttcctgtcagtgcactatcaccaactggtgcagaaagagctcctgtcaactgcgatggttgctcagacgaatcaaacggggttgttcccaagatattattggtaatcatatttgacacaccacctacagcagcaccaggagctgactcagagactccgttgggactatttggcactgggttggacatttgcgtgtgcatcccatttcgtgtgatatctattggttgtgcaccgttactattcgagtcacctgaaagagtcccattttcaccactagttgctgcagcttgtctaatcccaaaagtacttagtatggtaccaaagccagagccacgtcttctaattgtgctgctgccagagtcattcccaacattccctaccatttcaagagaaaaaaattatgagattagattagataaccaatgggaaaaaaatcacacacgcactttcacaaacgaaggtatcgtgtcaacttgttttaaccgtctatattttgaaatagattgagctcagcaagcagagatagtatctgttactgaaaacgatatgatgagattccgtctcaaaaaccacaataaaacgaatatgtgtaaaacagaacaacgaagttacgcgaactggaaagcgccttccgggtataggattcaacaacacttggaaacagatcaccgaactcaatacagaccctgtagaatcctttatatagtcctgaaataaaaatgtagagtgctagttgtctaaacccatagggtacaaactggattttaatcaacgtaaaaagtccatttttattttttttttatttttttctgcttttctttcctgaagatttgatgatatatgacattctgcgatatgtacggaaaacatggtgctacaaattgatacatacagttgaagagtttctttgaaaaggcgtaagtgtatatgtttgatgacaatttggagtgagctgatggtgcgttaaactcacttggcttcactcggatatatacgatatttatttctcacttttcgtagctaccccagttcttttcctgttgaaatctgttccttatcatgcacgtggatatgaattggagttacagattaagcttttaaggtttgagccgatctttacttggaatgcgaaactgcccggtgcagaaacagaaacggaaacaaagcaatagcatgaagtcgagcattttgaagggtttgcattgatcgtatattttcccaagcgcagcttgggaagagagagggttttatttattttgagaataatgttttcagtacatagtgatgattcatgtatcaatgaggctttcttaagttatgcaagctgtgtgtagagtcgtcatcccttcatttcaatttggacaagtcgtatggagtagagtttacagtgatgatctcttcgtacaatagtgtagttaaaaattcgctgaatttttcaccggtgatttcaggttcgaagtatgtagcagctagctcgaacttgttagcatcaccaacaggagacttggcagctagttctttagcttgttggtaaagaatttccttagcaagtgcaggagtgacttgtttaccagtatcctttaacacaatcttatgcttgacccattggtgtagctgacaacgggacacttcagcggtggcagcgtcttccatcaagttattgattggaacacaaccacttcctctcaaccaagcctccatatattgcaaaccaatgtctaagttttgcttgataccggcagtagtaatttcaccaccttcgatgttagtgtttaacaagtctgaggcagcgacagaagtttctggcacaaaatagatttggtttggagtacccatttcggcgaaaacttcgttacagatggcagcaagagctgggtgagcaacccaggaaccatcgtgaccgttagtcaattctctaatcttatcgttacggaccttggtcatagcagcgttgtttgcttcctcgttatccttgattggaatttgagcagccataccacccatagcgtgaacaccacgtccgtgacaaatcttgatcaatctcttgacgtatgcgttcataaatggagaggtcatagtgacttgatctctgtttggcaatacatgctctggcttgtttcttaatctcttgatagtagagaagatataatcccaacgaccacagttcaaaccagaagaatgttgtctcaattgccaaatgatttcttccatttggaaagcagctggtaaagtttcgatcaacacagtagctctaatggtaccacgaggaatggccaaggaatcctgggctacttggaaaacgtcattccacaacttggcctctagatggtgttccatttttggtaaatagaagtatgggcctttaccaatttcaatcaacttcttagcgttatgatagaagtacaaaccgaaatctaagatagaagcactgattggttcgccatccaccaagatatggttatcaaccatgtgccagcctcttggtctaacaatcaacgttggcaaatcagcgatcttaccacgcaacttgtactcttttcttggagtgacaaaatcaatttgatcacgaatagcgtcatacaagttcacttgaccgtaaatgacattgacccaagttggggaagcagaatcttcaaaatcggtcatgtacgtcttcacatccgagttcaaggcgttcaccaacatatttctcaaaggtggcccagtgatttcagtggaacgatcaatcaaacctggggctaatgggggtccctgccaagtaggatcatttctgatagcttctgtttccttcaagaaattgaattcgtattcgccggaatcgatcttttgttgaacaatttgtctgttctctagtaattgtaatctggtcttgttgaaagttctatgcaatagaacgacaaattccaaagcatctttagtcaagatatcggcaacggtagtggtgcttggagagaattgaggtttggtatcgacatcaactaaaagttgaacattttctaaattttttttaaccatgatgaatctttaataaagttttctgatagtagtctgtatagagcttttatccttccctatagatttagttactcagacctttatttaacctaaaggctagaattgagcccttcagaaaaaaaaaatgtaatggcaacccaccctttatatactttatgtgacgaaaataattaatcaccggtgccaattgagtgaattgttcttcttcttcttcttcttcttcttcttcttcttctcacatccctataaacttacctagtgaaacagtatcatgtatgacacatattaccaatataataggcatttacccaagataaactcgtcatggaaatcggtctaaatggtgaaactgatttgataccaggatgatgattaaaaggaaagaaagaagtacgaaaaaggaagaggaagaaactaaaagtaatagagaaccgcgaagaaagaagagaaagaatcaccgccttaactcagtaagtgagctgccgaccaatgatgttggctcatacaaactgcggttccctcagatcatcgagcggcgccaatggcatttcaagtctatttgactctgaattaagggcaactgagctgatcatctctgtaccctttaaactcacgcaatcagtatgtaatttcgtaagattaagggatcaggttttgaaggaacggacatcggggttctccgaacgaatggagaaaattcaagttcgaaaatttcccatttgtgcgaggaagataggtgggttcctttattgcgtttcttttgcctccatcccacttcccaagttattccgggatgcgtctttgtattcgggtaacgccgtgtcacgtgttatgcttctatttcccattgtttttttttctttctctggtctctctgtttgacaatgccgccaactactgttcataacctgagatgttatccattctatcagtccctttactagaggctatatgttccgcgtcagcagaaaaaaaaatgtatattcagattgtttcagcttgagtaacgtcagcttgttgccaattgatacttttccgcccgtgtttttggctctactgttgtgcgctactacaaacaacgcggctctgcatcgccgtctaatgctaagtgtgttcagcatgttgaatgttagcatgtacgttgattttgacgttggactctcctttttgttaccctcacatcgatgtacaggaaaacaaggttttcttggaaaactaaacaaagttttgttgaaactaaaaactatcaaagaaaaaatatactttagtattagaaatgtgtgcgtattgaaatggaaggaacagaaacacccaccaaaaagctcattatagacgtgactactgcattacgcaccacgataggttttgctcattgcaataaaaaaaggaaagtaacaagaatacctttgatagaattactttaaagacactatctcattccttctcgttaaagttctccaagataacactgtaccattaaccatttaaattagactgaaatatgtcattaccgttgttacgtccgtttgagactgtttctttggagaatgcagtcgaagaccttgttgtcagattcattctcaatgttcccccggaagatttatcaacagttgagcgggttctattccattttgaagaagcctcatggttttacactgatttcgttaaactaatgaacccatatttgcccaatttaagcattaaaagcttctccaagatcgtcatagacatctgtcctttgatttggaactgggatatcacaccagaaaatgcacttgtcaagttttcaaattataagaagaccattcccgttaggggagccgctatattcaacgatagtttgtcaaagatattattgttgagaggtatcaattcaaaacactggtctttcccacgaggtaaaattggtaaagatgaagatgacgtcgcatgctgcataagggaagttaaagaggagaccggcttcgatttaaccggattcattgatgctgatcaatacgttgaacggaacatgaatggtaaaaactttaaaatctttctcgtgaaaggtgtacctgaagactttgagtttaaaccagaacacaaaaatgaaattcaagccattgaatggaaagatttcaaaaaattgagcaaggcaatcaccaagaatgaaggcagtgccaaagttttcttggtcaattccatgattagaccgttgtccttatacgttaaaaacgaaaagagggccaaggatgaaaataaattgaaattatacgccgaggaacatttgaaatccattttaggattgaataagaaggagaacaagatcgtgcttgacgcaggtcgtgagttgatggaaatgctacaaaaatctgcaaaaacagctcaacatcaagccagaaacgagacatatgttgcggaaaaccctgtggttgatgtgaatcaagctcgtagcttgtttccacttatgtccgtccaatctgtttctcacttttcttccagtaataacaccaataataacattgtcaatggtaccggtatgacgataaataccactggaaataataaattggaccacgaaaaatcgtattctacggaacaaaatactgatttacaagcctctagcaaagaactactggcatttttacacaaaagttctactgtcaatgacaaggaaagacaaatttcaggcagtgatagcgtttcgtcattcccatctgctcatttcacggagttcactgatgatgaaaactacgaggaattcgaaagttcatctgacgaaagtcaatacgaaagctctcaagaacaacttggtcattctgacacggaatgggaccccaacagagatgatgagttattaacagtgaaagaacccaaaagtgtgaaagaaacacaaccttcaaaacctgtcaaacctgaaacaaagcaaggtgccacaaacaatcaaaaacctatacttttgaaacgtccggaatctcaaaataaggctaataatattgaatctcaaaccgtgaagccaaaaatcagattattgaggcgtggtgacacattggcatcagccacacagtctccctccaatgaatctattaaagcagtctctgagaaacgaaacgatacagaaaccacttcaaacaaaaatgcagccaacgacttattgtcaatcttgaagaagccatcagaggaccaaccaaagataaacgattcagagacacattcaaacagaagtgtagccaatgatttattgtccatattgaagaaaccatcgagatcagaagtaccaggcgccgcttcgtctcctttattcactaatacctttgagaatagtcaaagtagtagttcgaacgcttcagtggaacatcatacttcttccaataacgaccgtaatggttctaatttttcaaagcagtttactgcctcacctgcactaaacgaaccatctcctaaaaatgatgcaagcgacttaatgcaactactgaaaagaccacaacagaacagtgaacctcaaagtccaatatcagacctttctccagcaagcaaaccctcaaatgaattgcttaatatattgaagaatcccaagaccggcctaaactcgcaaatatcggacgatcctgtgacacacaacacccaatacaataggatgcctcctctgcaagtacagcctcaacagcctttccaaatgcagcaaatgcagcaaatgatgccacctccaggttatcctccccaaaatatgtcatatattccccaaggcttctctcctcagcagcaattccaatatcagcaaccgattaatggatatcctatgcaacctcagccacttaacatgggacaacctgcaccaaaccaaggttttactaaacagcaagaacttttgaatatattacacaagccaaatgctcctgttcaagaaactccttccaacccttcatctgaattattgagtatcttgaaaagatgagacattacagcatttcgcaatttcacttacatatatttatatatgagacttttcatctaaggaatattttgatagttcagctgtataattgaaagagctaaatctattattgttcagaatcatctgatgggatttcatactcttgaagaaccgctgttagttctgctttatcatctcttcgtatccactctaactttctatctttcatgccagttagagtggtaatacaaccgtaacacacgcctacattcttggcaggagtatcactcattttgtttagtttttcggctttgtctggattagctgcctcccaggcattgtagttggtcagttcttcctcattatgaatcacaaatggcttgctaactgtgataccgtcaagccaatttactggattcttataaataatggcattgcaaatactacagtgcatgatttgatttagttcattatcagggttagataattttgcacctgttctaacaactgtagatatcacgtttgagtaatcaccttcaatgttatcaaaatactgtctcgcgagttcattcatcgtcatatttttgataagtttgacatttttggtaggcttgtccacaaatttgtcataaaacaaagtgtcctggacaacataattatgagagaattgcgaaagcccttttatatgacagtaagcatcaatttctgacagtaaaacgtcccggcctggatgaaagtttctgaaggcggtattatatttactatcgagggaagaatcatcaagataacctgcgatttctgcaccacgtcctttaacagtcagactaatgacttcatcagctaactttgtcatcgagtgaccccataagatggctttgaaatttctttgtaaggcaaatttcttaatcaaatgggtataaataatgttcaaaagatcttctttcgctgttttgttaggcgcgctggcaagcactttctctacagtagtacttggattatttgatgatcttaccagagtgttgaagttatcaatgtacagtgtaatttcttgcagatcaaacggcacggcaaagaattgatttctgtcaacaatatggaacagaatcttatcggagttttctttatattttgatttcagaagttcaatcttaccgcgcacttcttcaaactctgcctgtccacaaatcgtgattacttctacgtgaaatccagtttttccccggtgtgtttgtttctgctccaacaaagtatcgttcaagatatctaaaactgccaaagaagaggatcccaaagaaagcggcacgagaacattggaatcttgattttgcttatcagcttctgcctgaccacgtttcttatctggatatgagattttgaatatatcttggaagtagtcatcagacatcatctgcttcctctgtttcaaagaaataaatttcacgaaacattcatcacaaaatggttcttttctcgagactagagttgcatccagcagcttacaccttttacaaatgaccatgatagttggacgcagcgataaggtttgcaagcacgtattaacaggcttttatttgattcagtgactagttactattaagagatgagatgagatgagattgattttcttttttttttttttttattttcatttcactgtggttgttaacatgaaatttcaatctagaaattttggagttctgaaaaccatagtaaaatattgaaatgttaaaatgaatccagatgaactagtagcagatgagttactggtaaaggggaaaataaaaaaaaggctcaagctagcaacttactgccttactaacaacaaatgaccgataaacaagaaacaacacaaccagctgaaaagctgcaacagcctgaaaaggtggcagagaacgtcgaccccagtctcgaactcaataagactaaggtcaattttacaccggaaaagactgatgtcaacacctacaagttctatcctgatgatccagaatctacgttgaacagatacagatttgcagtgaaaggtgcttctgaatactacgacccatgccaggaatcatctaaaatgtctttcaagtgccttgaattaaacaactacgacagagacctatgccatgactatttcgacgcttacagagagtgtaaaaagcagtggttgaaggccagaagagagaaaagagaattttgggaataattcaaccacatctgcatgtaaatagcgtacttaatgagaagtaactttctaatcaatagcatgaattatttattgataatgagcatgatcctccattcccatattgaacgacataagctaacaaacggaacctgaataaacaaaaaaagaaaataataacacaagttgaaagtacagatcacgtgacataaaggaattgatattacccgtctttccgaatattctccattgctcctaactattggaatccgactcgcgctccctccaaaacatggtttcggaccccacatgtaaagatttcgacccaaaaaatattccagatcccaaaccgaaaaaaaaaaaaatgcagcttcccattccgatcaaacacaaatacggattattacgagcagcatcagagattcccataggtaagaagtttccgtaatcgaaaaaaaaagtagaaaagtgcaaaattaattatgatatataaaaagttttgtaaacattgagctattgtatggaacaggacgaacgaaagcctcaggaaataacactcagtagtaagcatcaataggatctagcagattttcattgattgagatataggatttagtgaaagaaatttagaatcatatcaagacgctttattttggtttgttgaatactgaaaggaaaaaaggaaaatgtcggataattctgtgagttcatttgtgactcgtaacaagaccgccatcttggcaactgctgctgccggtggtgctgctattggtgcttattattattataaccaattgcagagggcagaattgggttctggttccagtggtagtaagaagacttccaagagtgaaaagaagaagagggccgggaagaagaagaaggattcgtcttcttcatcaaacggttctgatgtcgtttatccagtagacgctaacggtcaaccagatttgtctaagaaggatgagtttactccagaacaagttgacaaatatgctttggcgttgaaggacaagggtaatgaattctttaaggccaaggatttcgaaaaggctattgaatattataccttagctatttcattgaaagaggatccagtgttttactccaacagatctgctgcatacgtctcaattaacaatttcgaaaaagttgttgaagataccactgccgctttgaaattgaagcctgattactccaaatgttggttgagaagagctagtgcttatgaaaacttgggccaattctccgatgctatgtttgacttgtcggctgtctctttgttgggtgaatacagcggtcaatccgtggagcaactgctggaaagaaacatgaacaaacaagccacaaaggtcttgggtgaaaaattgaaggagaaccagggtaaagaatctccattaccatctaacacctctttggcatcattcttcggtatcttcaaccctgaaacttctttcgatgattacgatggcgaaaatgaagcagatgttgagttgaaaaaaggtttggaaaacttgtacaaatgtcaaaccggatgttacgaattggctgatgaagaattcaccaaggctgccgagttatacaagaaagaattagaatcttctccagataatgaatctttgaagaagaaggctgccatcgccttcgaacatgtgggtattttcaagttcttcaaaaatgatccaattaccgcgcatattaacctggaagaatcgttgtctttgaacccaagaccttctacttacatctacatggctttgattatggctgacaagggtgaagccaaccaatacaaggaatactttgacaaagctttagaattagatccaaactgctctgctgtttactatcatcgcggtcaaatgcattttgttgttgaaaacttcaaagaagctggtgccgatttcgataaggctaaggaattaaatccagaaaacatttttgcctacatccaatgtgcttgcttggctttccgtgacgatagatttgatgattgtgaaactttgttcagcgaagccagaagaaagttcccaactgctccagaagttccaaacttttatgccgaaattttggctgctaagaactctctagatgctgccatcaagcaatacgatattgccatcaagttggaagatgctttaccaggtattcacgtcggtattgctccaatgattggtaaggccactgctttgattagaaacccaaccgttgaaaacttcgttgaagcttccgaattatttgaagaagcttgtaagatcgatccaagatccgaacaagccaagatcggtcttgctcaactaaaattgcaacaagaagaaattgatgatgccattcaattgttcgaagatgctgccgatctctcaagatctttcgatgaaaaactacaagctactactttcgctgaggctaccaaggtccagaaaaagatcagagctgatccattcattaagggtaagatcgacgaagctattgcagcctaccgtgctcaaggtctcgcgtaaattagcatgatattcacgaatgaatttaattcatttcaatatgagtaaagctacaatagctcattgtttttgtctcaccttaatgaccataatggcaacataccatgcaacatctaaacgaatgaattaccaagaaagttatgattttacaaacaaaaagttgtagcatttcacccaagttatttatgactcgtaagcagcgtgaactgtgttaatcgtaaacgacaagatctcaacattacaacgtgaagaataagaaatagttatcaattcttcacaaaaacaagacaaaaagaaacacagaagaacaagaatacgagaacaacgcttttcaataacagctcattgcaaaatatgtgctcctaaatacccctggttcaaaaacatcatcttctaccattttgctagaaacaaatacgtctttctgtatatacatgtatctcccccatctcacaatttaatcaaattgtaattttaaacacttcgatagtatatcactacatacgtttcaacataaatgacattttttgttttctctgaaagaagtgtatgtaataaaagtttcttgtgagattatggcaaggtactgagtgaaagtgagctacaattcaagtacttcattgttaacggactatagcaggatttaccccaccagcgaactacttcaaatatgctatcttctatctttggttcgatgatgaacttttccgctagaactggacttctgggatctaaaactaatgtttcatcgctcatcctcaccagaaacttgatgaaaacacacaaaggtgccgcaaaaagatggagaaaaacagccaatagcttcaagaggggcaaggctggaagaaatcatggtaatgctggatggagtaggaactcccttaaatcattatctggcaggtcattagcagactccacacatatgcatcgtttaaagagattgcttccataccattaagagatgaaaggcaattaaaataagatatcgtttcgatttcaatcctgtacatataacaatggcatccccataatgaatgacacaccatttcttaccatgattttcagtaaagcatgtcatgaaaaatcagcgggttactataatggataattatcattaataaatacctatatacaatttgcaaacaacggtaaaaaatgattaatcatatatatagtcaaattaagtctccgagatatcattctcgatccaactacctgtttttggattctttcttaattctaccgttgggaagtagtgatagtttgtctttaaggaaatggcaaacggaacatcgtcaaatgtcattaagcgtaacttgcagtatgtattatctgggatttctttaacaaccttcaagaatgtatccaaatcaggtgttgattggtcattgacgtgtgtgataaagttggtcacttctattccgtactgtaacgccaaagaagatgtaccacgagaaaccgcatatacttcactaggaatagacgtttttacttgacgcacggcatgatgaggagcttgtagtacgcaacctgcgaatacgacaattctagtggtttcttcaatttgtacagtttttattttcaaatcgataaccttcgcatctcttacaaccttgaataacaactcagattcgatatccgtatcgtcatcagtccccacgacaccaccaatatccctcattctttttaccagtttcccattaactgataagataatatcaccaggctcgagcctttcctttattgttgtataggagtttctggtgacactgatgaattgtaatctgttttctgattcttcttccatcatcttaatccattcttcaggaacacctctgattctagcctgcaataatgagatggaatcaaatcctgcgtccacaatagaaaccttaggattcttaccagccctgagaatatctacaacttctttgatatccactacgtctaaacccattaaatacagtttttccttgttacccatgcaggataaccagattgctctcactgtaccatcatctgccgctaatattcctgatttacatttggtgcttatattcgaatcaatggagatgacttctagattggttgctctatacctaggaatgatgtcgttaggaacactcagagaagagatgccattgactttagtcttggaactgattaaagtgtttgagtacatgtaaccaatgaaattagtttcgtctcctctttcaagcctttcattagctagcactggtgtgcatactggggcgtcaactaaagatggatcatattgaacaatagcgtaattttgggtaggatgtaagaatacaactttagcaggtacaagaatggattcagcgaacgagacaaacgtgttcaaacagtcatgaggaacaaaactacgtgaaacaataacatatcccttctcagcatcgagtactaaaccacatccgtttgtgggttcgggttccatggagtccatggtgatagcaataaccgaatgtacaacacatagactatgtgacatttttgcaagttttttattatcattaatcggtagatctaaaatcttagctttctgtggttttattggaagtggtggtaatttctcagtgatcttttcataatcccaaatacctgttttgtcatttctagtatagattcggaactcactgcaccaatgacggtcaatataaacactggttattctttgtgtttgaacatctgtcaagttatggaatttcacgattactcttttttcgtcaggaattgttttcatgacttctataaagtcgtctagagttggtgtttctttattatctacaaaatcaataacccatccagttttctcctttggatccaaatcgaacgatccagtggcacttgccacgaaaacgccttttacaggtaacgcatagcatctagccatttggtacgaaagctcatggaaattagcaccacacacctcgacataacgtgaaggagtaataatatgcaggtcaccaacagtgcatctgaaggaaatatctttggaacccctttgaaccacaatgattatctcatctcctacactgctatctagaatgttatcaacttgaataaatgaacatattggtgtgccattaatagaaattaatgtgtcaccctcttgaactttattataagctggtccctctctgagaatagcctcagccaccagcaaaccagttttacccgggaacctcttacgagcttccttctcacgatcttcacttaatccaagtcttctacattcatcgaatggtttcaatacccactgagtttggatagtacctctggtgattggtttatccgtttgtacgcattgtagagctctgacgactcgatcaagaggcaaaaagaaatctgtagaagcctccgaagagccaccggcctgtaaagcgaccgcatacccctctacagtaataactggagaaccagaagaaccacctgatgcagcagcagcagcttgaatatattcagtattaaaatcattatacgttagctcaccatagtctggtgcatttctgtcaagtctactgatgaaccctgacaagatactcaatttttcaccagcatcgttaccaacaacacggatttcagaaccaaccttggccaaagatggtttcaactctagtgcagtgacctcgatatatttcaacttcgatggatcaaacttcaagaacccaaaatcatgaactgggtcgcgatagatagggatgacatcacactcttcgtgattgtcgaaaatggcgtatccgatgaatggacctggacccacaacgtgtctgtttgttaagatgataccgagttttgcatcaacaatgaaacctgttgcttccgacaccaaggcagcttctgaatcgaaaggtgcgacttgcgagaaatgaattgagaccaccgacttaacaactttggagatagtttcttgccatttagcgttgttattgaataaagagttgcctgaatctataggtacatcgttcacttcatcatagtcttcttcataatcaatatcttcgtctacactacttgtgttctgatcgacgtcattgtcgaccctctgtttcttggattcaagatcaatgtcttcaacagatgattcgagtaggtttcgcttcaactcaacagtcatttcaccagttactcggtacgtacttcgcagttgattattcgaagagtaatccgatctccagagttctgacagacggtaatgtctctcttcaattcatctcatctgcgctctctatgtttagttatcttcttttttttcatcttgccgttcccttcggtaaacgtcaacgtgaaaaattcattagaaaggtaatgaaaacgtattgaatgataaatgcgaagatggggacggtgagaagaaaggtatcggaggaaaccattcatgtgccatctcttagactgaggtcgaccataattcttcgtttccagtttgagtattgctcttctgatacgacttcatattcgtcttgtaacatgctgcctattctgacggcgatagcgttatcgaaatccgatccatcgtaataatcgaacttgacacggagttctcggtaccatttctcaccgtctattagttcttttgtgatcttgatagcttccatgatatcttcatcatttgttgttctcatttgtgccgccatcttcttcattagcttgttatcgattgtactgtcctgatttctctgttggttgaagacaacgaacgagcaaagaagtaccagaccacaaaccaactgtgtaggatacgctaggtaagtagcgttgttattgaattcggaaattatggtagctgttacttcttcaggaagttcaaattcattgcacagagtcaccagttcagcggtagacggtctatagtattttttgtatagcatgttccattcgttatacttacctcttttctttcttggtgaaggcgtgtatttagaaggggagtcacgaaagggtgactgtcttaatggagattcaggatcatcctcaactgatccaaacacttgtggtatattgatcatatcagtcttattcttcggggttgctaatatgggcaacggaaggccattttctgtatcagcttcaaacactaatttcctccggacacttgacctactccctttgctaggtgaaagatcaacattcttcaagggctggataccacttttagttcttgatttcgacggagtctggaatagctgttcttgtaacgacttcggatctatccctgtgaatcttgcatttttaaccgctgactttctaaccgatggtgatgcagtatcatcaaacttcagcaattgtccttcggtatccttttgcggcgaatgaggccatatgtttctcttaaatatattcacaagtttggatacttggtctggtggaagcgggatcttctcctgagaatatggtaggtcattgtcatacttctcagctagtttctgaaacgcaatcagtgcacatatatggcaccgagcaagttcctctgaattcttcagcatcactttcgatactgaaacgttgtataatgttgctgtagtagaagccactttctttaaccgttggtcttgccagtcaacattagaatcatttttgacccctaataaatcggttacacacgttcgtacttgctgcgtagacatcttaaattatttccacggattcttagcactctaaagtgactaaaataggatcatctactcacttgttgtattacactggcccggaaaagacatatatctcatctcatctccatggaccatttttaacataatattaaaaacagtctttatgtagctttttgatctttttctgattttctcgattttctccaatattgaaacaaaatatggtaaataatgaaattgaatattaatcaaaagtatcattattcgcttctccatctataagttcagttttggcaatacttctagtatttcatctagcataagttgctattccagcgtgtgtgtatattttagttctcatgagtgggtactataatagacagtactctcattttcatgggaataatgatcggtaccaaaccggacgatatgcatatcaagaaaatgggaataggtacaagggcttccaacggaatggatcagggaaccgaagatactcccgcgaggggtttgggtctcaacttaggaataatgagaacgaatctcgtccaatacggtcgcagtcgcgtggtatcagcgagattcctcgtaatcccttcgcaacgcgtccagtagtgagtgcgaaatacgatcgcgatgagtttaatacaaaatatcattattacgacattgtaagtaaacgactacgaaatgaatccagcttcaagaaatggaaatctgagaagattcctgagcatggatatgtgacaacaacggagttgattgcatcggataagcaaaaaccaatactcatggccaggcagcctgaacaaacttcggtggatccgagaatacgtcctatgaatggggatgcggtctctgggtccatttctgcgaaaaagagatatagaaagcttagaagtgcattggtacgcaactcgcgaattccgtatgattctttctacattggtcctgaacctccaaaagaaatcatagtatacccttctgcatctaaccaacaaccaatagcagccgcattatctgaagcaataatcaaaaactactttaaatcatttggtgaaatagcgcattttgaacagttcatggatccaaatagtgcattgccattgtacgtctatctaataaaattcactggtccagtttctcaacctgatgctccatataaagctgcttataaggcatcagagaaattcaaagacgcaccttacacagtatcaggtatcaagttcaatgtcattttaaaccaaaatacagtgttaaattcaataaaggacaaactaatcaaacagaacgcagccagagtgacagaagtgaataaagcgaaacgggccattgcagagaaatcatccgggcagaaacctcaagtaataagaggagtgccatacgatttaactcaagttgtgaacaacagaccagttttgtttgttcctgcaaagattacgttttatcataggttcaatgcagcagatttcagatatcaacttcgtaagtacaattgggccaaaattattgatcactacactggcgtatatattgtttttcatgatctggaaaatgcaaaagcatgtttagagtacgaatcaggtgccttggtcataaattcgcataggactcactctcccatacaaatagaatttactttcattgaaccaaagaggagacttcaatcaaatatcactaaccaaagagatatcaataaacctcgaaagatagagtactcaagcacggaagagctattagaagcctccacaaaacaaattctcaaagatttgcataatatcattaagcgtgatatcttgagaaggcttgtaggtccaattatatttgatacgctaaatcctgctaactacccggaagttgtagaaaggcagaagaaactggacgatgagaagaagaagcgtgaggaatcacaaaagaagacaacgataaaggccaaacccgcagaatttgatattttcagtctatacggacctgcgtctaaaacaaaaaagctgaaaagagataggaaagctgatctaggcaaacgtcatttatacactgaagaatctcctgatcatcaacgtaaaaagaaacctaaggtggaacatatgtcgcatttgttaaatgatgaaatttctaccagagaagatacagtggattcactcaatgttggctcaaacggtgaaaactctccggagtcatctggatatgaatcggaagatattatttcagatgagtcgaagaaacagtcttccgtgataacaacaccggaggaagacctgcccgaaagcgctgcatctttacctgatgaaaggtccaaggaattactacagtatgaagggaaatacaaacctattgcatcagaattcccaaccccagtatatccttatgatgactttgacttgaataaatccaagcagctttctctcgataagttccagcttgctttgaaagacgaagaagatttctctattctcaagggcattgtctcagaaaaatcaaaagatattactactgattatacaccatttttgccgtactcaatgtggaagttataccaacagattgaacaaaatggaattattcgggataaccaaatagctttgaatgaaaaagaatttgattcaacgttagcttcaacgactggtagttttattgctgatggctttaagaaaattcctgataaactgaaatcttcataccttcttcatcatcggaggttggcgcaacctttgaacactgttcataatcatcaagaacagaatttcatggctttgaatggaacagaatcaacaaatcaagaggctgacttagagcaagataaccataatgcatcctcacgtttgaacagagttttccaaagacgtttccagcaagatatagaagcgcaaagagctgcaattggctttgaatctgacctattatcattaaaccaattaacgaaaagaaagaaacccgtcacttttgcaagatctgcaattcacaattggggcctatatgcattggaacctatagcagccaaggaaatgattattgagtatgttggcgaatcaattagacaaccggtcgctgaaatgagagagaagagatatatcaagtctggaattggttcaagttatttattcagaattgatgaaaatacagttatagatgctacaaagaggggtggtatcgctaggtttattaatcactgttgtgaacctagttgtacggcaaaaatcatcaaagtcgatggccgaaagaggatcgtcatttacgcgttacgtgatattggtaccaatgaagaactaacgtacgattataagtttgaaagggaaactgatgaaggtgaaagattaccatgtctctgtggtgcaccatcttgcaaagggttcctcaattgatttccttttcatgcatttcttttctataaattgcaaacgctacatagtttataacattcattttctcacgggaattcttttttttcttgaaatgagcaacaaaagttgattagtttggcaatttcaaacatgccgctaattgaaggcatcatgatctgcaacttaaagcaacatagcggcaggtgatagaatgtataggagaagcactgctctattgattccgtattttagatctagttttctgcgacgttcatctacggtccaaacaccaaaaactgagaaattgaagatttcattattgaatgatgataccttgattgaaacagaatctcttccaacttctgcaattagaaccaaatcaagtgatcgcggtggcagagagacacgtaactcgttacctccatctttacaatatgtacgcgatgttatggataaatataccggacacgtagtgctcacacagattggatcgttttatgagttatactttgaacatgctacaatatacgcaccaatattgaacatcacactgaccagtaaatctattgtttcagggaaagtaccatttgcaggatttcctttgaatcaattgaacagacacttaaaggtccttgtgaaacaatatggatatagtgtagccgtatgtgaccaattcaaacatgaaacattagttgataatgataaaaataagttcatgagaagagttactagaattgtcacacccggaacattcatcgatgaagctttcgaaaatttccaggaaaatcagtatttactcactgtacacttctccgaaaactgtatgaaaagagctgcagatttgaacattccagtaggtttgtcttggtgtgatatatctactggtgaaatatttgtgcaacaggtatatttgaaagatttagtgtcttcaattactagaataaggcctatggaagttcttttggatgaggagataatgcccgtcgaaattacgaatggtgaatggtataaggaattaacagaattgaagaaatattttatcaagtatcaaaagatgccttccaaacatcgtcctattcaatccttctttaaattgttctcaaatgcagaaggtgacattggaagatcattgggaaacttcacccaaaaagaaattgcggcactcagaaacctcctgctttacattgaggaacatcttccggatatcaacactaatctagaactcccacagaaacaacttatcacagatataatgcaaattgattccagaacaagtacagcgttggagttacattctacaatgagaaaacatcacaagaaaggctcacttttgtcgacaattcgaagaacagtaaccacatccggaactcggcttttgactcagtggttatctgcaccatcaatggacataaatgaaataaaaaatagacaatctcttgtgctgctcttcaaagataattttgattacactgaatcccttatacggtatttgaaagaaactgctgatatgtctagaattatacaaagattctcttttggacgcggagatccattagagttaattcaaatagctaagtctttgaggaaatgtaaagaaatttctgaatacctccagactaatgttcatccctcaaccaaaaaaactgagaaattgatcaaaaatataacgaaacaacttaatttcgaagatcctatcgtagaaaaagtcataagcagtcttaatgaagagtcgttaattaaacaatggtctgaaaagtatgagagggatgacgaagaaaaatttgatgccagcgaagaaaatcaagagagaaaatctttggtgatgataatgaaaccaagtgcatcacaaaaattgaaagaatactataaaagctacaacatcttgattaaggagaaagaaagcttattacaatggtacaaagattggtttctcgaacgttttaaacttaaaaacgtttcattaaaacagaaaaactccggagagttttgcatacacttgagtgggagtattgcaaatgtagttgagtttgataagtacattgaacagcagaaagattcatctcaagcacattctgggttccatgtgctccaaaaatcaagacaaactagatggataatacacgataaatgggaaactttgtccagagaaattgaagtagttggtgcactgattaaaaatgaagaagagcgtttaatcaatcaatttcaaaaggatttcatttcattgagccccatgattagatctttatctcagacgcttgattatatggatgttctcacttcatttgctaaattggcaatcgaacaaaggctagtccttccaaaagtcactcaaggtacggagcttaatataaaaggtggacgtcatctagtggttgaggccagtatttcgcagaaatcgttggagagtttcacgcctaatgattgccaaatcaactcaggcgaactttgggttatcactggacctaatatgggaggaaaatcaacatttttgagacagaacgcaataattgtcattttggcacagattggatcatttgtaccttgtgaaagtgcggttattggattagtggataaaatttttagcagagtcggatctgcggacgacctttataacgaaatgagcacattcatggttgaaatgattgaaacaagctatattcttaaaggtgcaaccaatagatctatggcaatcttagatgagatcggtagaggtacgagtcgctcagaaggtgtcgcaattgcatatgcaactttgaagtatcttacgacaaataatgcctgccgtgctctgtttgctactcattttggtacagaacttgccagtacgatcaatagtacatccaatgaggagtttatcaacaatatatctttttttaaaacaggtattattggtgataactccaatttctattatgatcataaattgaaaccaggtatttgttcaaaatcagatgctattaaagtagccaaattggcgggcttccctgaggaagctttggaaattgcttctactttattggaagaaatttaagatattatatgctatatctaacgtaatgtacctatataattgttctgaacaaaattaccaaaatgcaatgaagataatcatctatagtgatttgtttaattgttgttcatagatctttcatgaggatcatttaaaggcctagaaggggtatattgctgttgagcagcagattgcccagattgttggaaatttgggaaagtattcattggttgtgacactggagtggtgtttggtgggaaaaattgtaggggcatgtttggtagtggtatattgctctggggtggaaacatttgtggctgggaagcaaacggttgttgaaactgttgctggtactggaatattccttgctgctgggcaagtggttgattaggataacttggatattgaggttgataaaagcctccattgttgtatggaggttgttgattaccatacgccattggttgagaaaattgtgggttgtacatatgtgggaatccaggcggaaactgcattggattagttggaactattgattttgaatgcggtctttcatttttcggtctcttacaagaaatttgtccctcagaactgccatcttcggtatctctgtattgacttctattttctctgatatttcttgaacgataacttactgtggacttgttactgtatggtaaaggatctttattcttgaaggcagttttcccgccagccgtattttccgaatcatcgtcattattcttgcgttttttagctagcttctttttacgtttaaactccatctccttttcgtcatcagaaaactcttgttcattttcgggcagctcttcatcgaatccgttagaagcatccgttcctttgatttgcttcagctcaaaagtgtccacccaacgggcctcaggagtaacatagaataccttggcaccaactttggttttcaaatcgttgaatctagtggaactgatttctttgtctttatcgaacgatactctatagaatggagcttgtaaagggccaaagacctcacataccggaccaaccaatgtcttttcctgtaagcaaagtatacttccttcctttaaaactctttgttcccctgaaagagatgcagtaatgatgatattgtgctcaaaagcagatttaatggtgccgatttcattaatggttgccttctcgtctataatgaagtcttcaggtaccacaggcactggttcttctactaattcgtgtacggatcgaatcggtcccgttgcagccggttcttcgtcatcagcttcttcgattaccggtacaagatcatcaccatcatcatcaccatcatcatcatcatcgcttgaagtgaagtcagagcttgagtgagcagttgtttcaggactagatattccactttcagcgttgatctccttcacttcctgttccacattgtcagtattgtcagctgtctcggttatcttggtagtttcagaagcctcagtagtctcgacagtctcgctagtgtcagttatgcttgtgacagctttagactcgttttgcaatgcctgttcaaataagtcaacctctacgccagtcatgattaatactatgagctctcagctaagtgtccactataacaacttgagttgtctttcgtcaactcgcttacctctcattaagggactacgacatatacatacttaagctcatcgaaacttttcatgcctctgatgaaattctcagattttcatttatttctttttttttcttgtggtccaacagagaattcaagcaaaaagattctccggaaatgtcatggagaaactgtcgattaaaaaaaaaaaaaaggtacagatatggataatcggaatgtaacaagggccggaaaaaccaaactccaaactgatttggtacagccgtcccagcacacatgtacaggaagcggttccaaagcgattctaaagtagttttaaatatacgaatctagtattaaattctaaaaacttataaggcttgtgagagctttgtaaggaatcgtgcccttagttaaaagtggggttaacgggtgtattgttactctcatatacaaataggcaagtggctttgtgtgaaatactcaaattaataaaccacccacaaacaataattttacacgcgcttattctgcttagtacctgaactgatcagaggccagcttctcgattgaattcaattttgagtaattcaatcgcacaaagaaatgctaccttatcatatttcttcattgacttactttgaactactattttcagctagttgaaatacagacttgaaaatggtctgtgcgtgatcataatggaaacggtagttaccacagcaatctaatgcagccatgttcatactaaaataatgatgaaaatgaatcttaaaaaaaaagaattatactactctaagataaacgcaacaataaataaggtggagtttcgatgaggaaaaggtaacgaagttagcgaatattcctcgaattcctaaaatatgagtaattgaatgacacattggtttctttttgccaaggtgttctactaagaaagaggatcggtattattttcttacgctgttgcagcttcagtgatctcctttaggtaaccgagttatatgaaataaggaattagctgaatttctttagtcatcacatatataaaagccagctctgaagaaaaaataaaaatttctggaagaacatagccaactcatttaaagaatcttctactgaacctggtgacctcatattttctgatgagaccaacagaatctaatacgtcggagattgattccatttcttctgctagtgacgtttctcatattttgtctgacccgcatggatttgtaccgaaatccaaaaagagtcaactggcagattcagaccaacgtatcactagaaggctttctgagccttctagtatcaagacagcggacacaggacggtctactatcattactggtatttcaagaactgttacgaggactttgagcacgatcaagaaggcggttgatgatgataatttacaagccgacaataacaccgacgatttaaacaaattgttggaaagaaattttgatattgatgatgcattacggttgacagaaacagctaagagaactgacagtcgttacaccaccaacactaatactaatactaatgccaatgctgttaatgctaagggttcagataaatggtttgatcaaacctctgatagtgaaggtgaatatcgatcggaagttccggttgaactagccggtgatgatgaaggccagacacttaataaagtctttaccaacaaggagaccaacactttggatcttccaccagagggaggatacggttgggtgtgttgtctttgtgtcacacttgttatgttttccacttggggttgtaattcggcgtttggtgtgtttctagcattttacttgaacaattcaagctttccaggtgctagtaaatatgactatgcattaattgcaggtatgactgtattctttgggcaagggttacctccgtttgttctcttatttatgagaatctttggtttaaaaattccaatgtatttcggtattgtgattatgtgcttgggtttcgttttagccagttatgctgtgtcattatggcaactatatttgactcaaggtttccttagtggcgtcggcatttcgtttattttcgctcctgccactaccgttttgcctgggtggtttcttaaaaaaagatcatttgcaatgggtttatcattgattggaacaggagcaggtggtgttgcatactctctagcggttaataaaatgatagaaaataccggtaatcagagatttgcattaagaatccttgctatcacttgcagcataacttgtgtagtagcaacccttttgctacgtcagagagttccaatgaaggctactgggatcagaaattggaaagcaatcaagcaacactgtaatgatatgttctcgatgcacatattcaaaaaatggacagttcaattaattgcaatgtggttcatgtttgcattatttggatatactttaatgatatttactttatcctcatacgctgttgctaacggcttgactgctcatcaaggttcctcgctaacggcaatcttgaacggtgcccaaagtgtaggtagacccttaattggatacacaggggataaaatcggtagaacgaatattactgttatgctaacgttacttttaacaattttcatgttcggtttttggatccctgctgacagttattcatctttaatcgggttttcaatatgtgtcggtctatgtattggtgtagctaatgttatgaacaccgtgctagttgctgacatcgttggaccggtagattttttgcccgcttggggttatgttaacttggtgggctctccattcatgcttgttgctgaagttattgcacaagcgttgactgaacccaactccaacgacccatatctccacactcaaatatttgcgggatgttgtttcgttgcggcattactccttatattgggattgcgggaggtgacagcaaagataaagataaaagaaagacaaacgataaatttgcaacggttaaaggattatgatgattcaaacttatcagaaaaagacaataacatcttgagagaaagagagatcaagtatgattacttacttggatcaggcatcaaaagctactttgcaagaatgttttatccaatgcatgtataaaactctttccacagagtcatctattcttttcttccgtctataaaagtagcattagtgaagtatcttacttagtttatttatttcagtattttcatcccacttcaaatccttgatataagcattgcattcattatcaaaatccttccattgatcaaccaacttctttgaaattacattgaatctcattatcgggtcatgcaaattttggttaggatctaagttcatctgaatgcaaatctcatgaatgacgttatttagctcagagtaatttagcacaaactcataactcatatccatcaataaaaccaaagtagttggatacagctgatgagtgtatgttccaagcgaagcacctgaacctgaatataaaattggatgattcaaaatatttgataagaatacagaatgagctctttttagatcctcaagatcaaatgaagaatagccgctaacatcatctgtcgtaagttctttgaagttttcgataaaatgaagatcaggttttaaaacaccgcttgagacttttaccccatttctaagcactttaactttaaccgaggaggttggatcggtatctttatgatttagattcgaaagaagcttcctaaattcatgttcaataatactctcgaaacaatatgtttcaacttttttagtgaaagattgaatctgattctttaaaacattgatcattgaaactttattcagtaaatccctaataaatggaaccctgatgttcagctttctaaaaagtttaagaatggatgaatttttttgccattcttgttcataattgtactcattctttttaattctccataagaagttgaaaattctcagataatctctgcggcttccgtgttggttgatatccattactgttgaaagaggctgatccacgagatagtctaatgtgaaaacatcccaacccgaagatccatgtgctaattccaaaattctagcatcaagcctattcaccaagagattgttatctgatttgttcaatctatttctcagagatgattgttgaattgcgatttgtagacacttcgttaaatgatggctttctaaaagttgagaaggttggttgaagagattttccgagttttgaataatagaatcaatcacatcgcttttacccattagaaggatatcttttaaaaggttgagagtctcgaaataataaaatttcgatcgtaatgtggtgttgatatagtggttaatttcaccatattgctggttaaccaattcgaaaaatttgtgatccattgaagggcctaatagcctatattgcaatgaatacttatttgcaaattttccaatccattcaacttcgctgcagcaatgttcgagatatcggagggactttccaataatgtatatttttttggccactaaagacggtataaattttggaattttctgtggcaagaataccaatcccaatggttctttctcgtcattttgaacaaaaaagtcactactaacatttgaatccagttttccatcaatcaaccaatcgcatatgttcttcatgtagggttgtaaaagacgctctaacgcatcagatgcaaatttctcgagtactggatcaccattacttttttgtaactggcatacagatagtaatccctctgcactgcttttttcaaagttttcaatatattccatatatgtccttagttttagtacttcaggatagaggtgttgatatgtaaaacataatggatcgagtggatgtaagtgggatgagaaattgttgacgaaattactataatctcgaagtttactttgaatcaatgtcaaaaatgctacttttagtgtactggtggtaacatgttttttaagatattccactctaatttgaaggtgcaagtaaagtaagcctgcttcaacgatatcatgcaactgttggctttctccgttcggaatattgctgggtattgtgaacttcttgtcttttagttcgaataaagtagagggtgttcccaacacaagatagggtatacttttaacgatatcggccctcgataccattgtgctgaaatatggatctgataagctttgtaatgtagcatcagatgaactatgttgccaagcatttcccccataggacccaattgaccttctgtccgataccttctcaaaattctcaaaagaatccgcatagacgctttccgttgttttcctttgtatattttctatcacttctttcgacattggttctctcatatcatacaactcatcgtttttgtctaaaagtgacaaacattgcagtaaatatttatgtttttcttccggacttgagagatggcacatgatgccggcaaacatttctaaatgagaccaacttttcatgtcctgattgcgttgcaccattatttttttataatattccaatacttttgtgacattttcctttgatgatgttttgatagagtagtaaaggtcctgaattaattgctgagaatacgcactgccagcagatgcaggaagcatgtgtagtacacatgtgccaaatttttggtccattattgttttttccgttaccccacagtagagataggggaagaggctctttttcacatcttttacctttcactttagcgcacaaatcgttcttgtttgttgatattttcacaaaacaatatcgatctactgttgttgtatccaatgatgtaaacataaagtgaaaaaggttgtgaaatagtcacgtgattgactttggtgaccatcacaaggattgaaggaaagacatatgcagacatacatgtatacataatatatatatcaatacagtacatgtataatacatttgtttaacttattattatgccatattttttaataaggagcagagagtagttcagcctcccttgaaaagaaagagttagagaatttgtcatcgtacccgcaatgttccatagttcttttatagtgatagaaattgtagaattgcagcatggcccgtaaagcaatttcttggccataggaatcgttgatctcgcccgtgatatccttccctgttatccagttatctgttaaatgaagtttctcatgtaagaacactccagaaatcaattccatatgatctgccctccatcttttattcttgaatggtgccaattcgtgaattatctttaatatggggtggtatatgtccagattaaagatagaatacaatgccttgaatatgttactaacattaagtggtaggtcttttagcctttgtgtctttttcccagttattttggataacactcgtaatagatacacctcggaattgagcattcggagatttaatctgtttgctttctcatttgcggttgatatctcaagagtttctttatattgaacattgtataaagaacattcactccaaaaagaatgggtaggttgtaaatgtttagagtaaattctgttttgatattgatcagtaaaagattgaaggatgcctacgcttgtcgtaatgaactttgaatcgtaaatcaacgagcaaagatactcaaatttaagaaagtggctaaccttaaaccattttaaaaggaggaaaagtatggcagaactcgattccattgcaatttcctttgatcttataagttccaattgtggttgaagctcattaatttcttcttcagaaaaatcctcttcaaggtatactttgtttgacatacaagtttcaatagtttctaatagaacatatactagagatgaaaaatggggtaaagcattagcataataatcttcgatgcgattcatggtttcaggttcctcattctgtatacctctatacgtgaatgggtccttctcatgtacctcagtgtttgtccatcctcgttcttgcaccataaataattctctttcatgccatagttgtttagtagatagttttatatgcacagattttgacaaaatttcgattgcttcttgcatgttatacggtaacactgtctcaggcaccgcaatactcagcttattactaagttcgtctaccacaccagtatcatagtcaccagaggatggaaaaaatgctggatatgataaattggcttgaaatgacttcctcgttttcaatccgttgggcgagcttgtgggtgatgccggctgtgatggtgcaggcgttgccatatgcacttgtggctctcccaacgacatgttagaactgctcctcgaacggggtctcggaatctctaaaaattgtgaaagagaattggggttgtcaagcatgctaggatatgtcggttctggaagctgagaagatggaaatcttgaggtgatatcttccctaaaagcaacatattccaatggagatattgaaagattcgaagcagaggagtctttcttttcaattttgtgatgttgaagaacaaatctcttcactgcgtcataatggctctcttcaccaaactgtaatagaagcactttatggaataaaataatgatatttcttattctcattgagagtcgacttttccaacgccaatggtctatatattttgtaaggaaaagcatcaagccagatgaatgtacgacatcaataaaatcttctacagctttggtgtgcatgcttctttgctcaatagctatattgatcataaaataagtgattgaacccgagtagaacaaaagagtattatattgttgcaaattagtgttcttcaccctacaacaatctgcatgtttcttaaagcaaggtaagagtacctttgaaatcatcatcaatagagtattattcctccgtagaatgtctaaatgatggaaataactgttcgtttcctgaaaagttccgaaagaaatatacgccagacaaagcaaggtattgatatccactgaatttacctctagctttttaccaagctctgtaataacttgaatagcgtatttacgctcttcgataaatttcgaactatcatagtttttttcaaagctcaactttgcagtctttaagctcccatagtccttttgtatgaaccattctgatagttcgtgaaataatgaattaaaatcggaagcctgccaatctaacgtaggcttggtaaatgaatgtgaaagatcacctctttcaatctcgtctgctttttcttgtaacaacttctttaatgcatcgtctactggtaaattattatcttcttcaactttgacatcctcatatgtaattattttatctttgtcattcaattcgggtgaaaccttccttagttgcttcggtgatgcttgtccgttagtatatgaatcataaccttggaaataatctttcaggctaccagaactagaactgggggagattggtccatcgatctcatcgacatttgcaaactctgaatcctcatcatcttcttccccattagcatcatcctgagtatcaataatctcactgctattgttcgcttcattagattgtctatctgtgccgttgttttcatgctgcaattcatttgaatcacccaaatgtaatttcttgctaagtaaactatccagatcatggaataaagacgtatccgaagggaaagtctggtgttcattggagagctgttttgcaaatggcggtctagcctgagtcttgctcctcaaatctttagaagacaaagacttcaatagcggagatcttgaccgctgtgtctctggcattatcgcaatccacaaataatattggattcctttctatctctcaaattgaataatcgttaattcaatgttgaaaagaaaacagctcttcaagccgctatcaatagaaaaccacgggagtagttcaggcaatacctcgcaatgtatttgaaccacaaaagtaacgttttctaaaaagtttaagtgtatagttgcaaacgttcttattctaacatgtctgattgaatgcgatgctacttttttttggattttgagtaactattcaaatgcctgaaaaatgtgatacacacaaattaaaactgaaaatctgtaagaaacaaatcgaatttgactcgtgatgttcaatcgtggaagagtgaccagcaagcttttctggccgaagccgctagtttatatttgattgcaaactaaatgagcatttctctggagaatattcttggcctcaaagttaaaattactgatgttttagaccatgtaacgcaaggaaaagtgtattcattcaactcaaataatgacaccatcactttgattgtgggcaagaaaaataaagcatacacatttgagatcattcagacctcatttatcaagcatctggaactagtaggagagaaggctaatccgtctagtttcaagaaagatcatgtaaaaccgtcatacgttgatctcgatagagtgaaaaatgcattggctaagacaatagacacagctgctaaaaaggaaatgtcaattggaaaaaatgtttcctatgagggtcaatttatatttgatctcattcataagactatatcagatatagtatggaagggaaaatccattgtcgttcttgatgagctggaaataaatccgccgtatcagcttggtagcattaaaccattgcaaggcagaactgatgtcaaatcaaaagagttgatagataagattgttgaatctgcatggaataaattagagaacgaaagaaaaggcggatgatgccggatgtcaatgtaaaaatatatagtttatttatttacagattaaaatttaacttatttcgttcggaattaaaactggatagaatacacatcgccttagatgatgcccactaggagcaatctctagcttgtccttcgattaacgtcactccgaatttcaaagtaacatccaccggatagaaattgaatcgaataatttaagacctttcccagaggttcctttaaacccatcaagttcctcccatggaatataaaactcaaatcgttcattcttaggtaaaatgtagttggagtcattatcaaggttctttgactgaagcacagattcccaataaagatttaaccagcaacttgaaaaagagcttaggtgagagacgttgtttataaattgcgaggtctttgaacggattccaaatgataaacggatatctgagaaagttacgttgatatttggaactattatttgctttgaagttaacgaccttaatgatcccttgcctgtagaacactgcttggagaataaatcgataagacccgattttccacttgagtgactttgtatcttaatggatactgttgtattattggcctttttcaagaattccgagctatattgaccaattgaatttgtaaactcgattgacaaaatcttgaattcgatggtagaaaggttctttattatttcttctcgttgtttagcttcgtatcggagaaacatttcttggtacttgagataacgtagttgagaagctatggtaactcctttactgatgcctgtcttaaacctagtgctcagaaaaagagattgtgcttcatgacgggggagctgcaagtatgtcatcaaatatgcgactaccagagtgcccgatctccctttgcccattttacagtgaataacagctactttcccccttgagacagtatctcttatatcgtctattaagttctgaagatgcaaaaaagatggtggtgaatgatcaatccatccagctctcaacaagtgagatttcacagaaattggtggttttactatttcatctgcattagatctgaatagtaatttgattccggaaacattgcaatggtcttcgagcatttttctggatctaaaagtggaagtaattttttcactcttaccagctggtggggtcacatgttttgattccaataccatggcaaaatcgtcatcagtgtagtctgaatcattcatttccgccttcaaattgtagattttccagttctttctgccatgattcgcatccaaatacgtgacaagatcaacgagactgttgcgataaaacattttgggatacttcattacaggatatgagcaaacaatgatgttgtcagtaacatacgaaacatccaaaactaatcccatattattcttatattgattgaaaggggagctgtagattgatttgatgatgtgctccggattaaatttcgataaagtcattttgaatactttcagtacaattatacttggtgaagatcttagtaacgtcaaagcgattgtccaaaatttggccgactttgaatttatagatgtagaccagtctatttaatactggtggtggggaagttgtaaatgagtttgaattgctagttttcttaaatgcaacatttgtgtcacttcagaaagtacttgacaacagtgcgacaaaaaaaaaataagaaaaaaaaaaaacaggaaagacaagtatcaggtagaatagttatattattccagtaatgaactcgcatttaatgtttcaacgatgtgatcagcaattgcgtttagcgcatctgatatgttgatatcatcatcatttttcagttcgaagagccctgtattccgtttaagctgtccttcaatgtcttcatcttcgaacatatacttatgttcgttcctgtaagatttgtaaacaaattcatcaaagtagtatggtggatcaacccaatatgaatctatagtcttgtatccagctcttgcatttcttctctttttcaaaacttcgtatggagctcgaacaaatattttgatgtcaaacttctttgttagctcttcatcgttaaatatcatgaacccatcaaccaatacaatcttaagatcagaattttgcacgatagcatatttcctcttaagagaatcccaatcttctggtgatatatcaaactttgttatgtcatcaacgttatcgttatgaatcaatttacttttgattaagccagtttcttttatttgatccaactctcttttaaatgcaggtatatccaatgcctctggacagtcccagtcggcaatctgatatttttcgtttagtggaatttgcgcatcaggcttatagaagtcatcttcgtgtaatacactacttctagggattgcattcgatgttagcttggttaaggtggtcttacccgatgatgaacatccacttatcgcgatgagaaccaatttagagctagtcattcttttctcctaaaatagtgggtttaagttgataccgcttacttcgtacgatgtagggaataaggaagtaaatatgtcccaaggagctacctcaattttccctacaaatagcttatgtgacgcttttcattgtcttgtttggaagatatgttggatctttcttatctattgtcctggctttcaatttttcatgcgaaaccatttttgaattttgtcaataaattttgagaaagttaacaatcctgcaagactttatatgataaattcgcagaaacttggtacatgagaaggcaatataggttattttgccctacttaacagctttgtggaaccctccaactgaatcgatatctgaagcatcttttcatttactcacaatgtcggaatttattaatgagaaccctgatattttagatgagaccctcctaccgtccagaaaagaagatattacaaatgaactatttggtgatgccttagggaaaatcacacatgaaagaaaaaggcagttgctgcagataggatctgtagactcgccagttttgaaaaacataggtcttctagataaactattaaaccagcagctatctttggatgagaccgtacctgatttgacagatatagaaacagcaactgaatccgatgaaaacactgaggaagaagaagaggaagatcctatcgatgctcaagaaatctacgatcttatagctcatatcagtgacccagaacatccactaacgctaggacaattagcggtggtgaacttggctgatatcgaagtacatgatacgaacggcaaggataaaatggccgaagttatcgttagaatcactccaacaattacacattgctctctcgcaacccttattgggcttggtattagagtgcggttagaacgtagtctctcgcccagatttagaatcactatcctacttaaaaagggtacacatcaaagtgaaaaccaggttaacaaacaacttaatgacaaagaacgtgtagctgctgcctgcgagaatgaccagttgttaggagtcgtttccaaaatgttaagtacatgtaaataatgatcaccgttttgattctattgagcagaaacatccaaaggaactgctgctacgggactcccacttgtccaaaccgcactctttttgtcaggtcatacagccctgatatttcaataatgaaaaatcggcatgctgaaaaaaacaaccgcaataataaaatattaaaaaataaaaatggatcccagagcaacattttgatgttagtgtttgggtatgaatcattgctgaagaaccgacgtcaaccctcaaaataactgccagtatgggtgttttcattccacattacaagctttcgaagctaaaggagtacaggtatgttactcgatcatagagatgaactacattctgtttcctttcttgcaaggaaatgatgaaaaggtgatcatgagttactaaccacatcgattaaaattgaatgaagttaccaaggtgaggacaggtcgattatctctaagtatactttgaagccattctggtctcaatttgtgaaaatttttccattatggatggcacctaatgttgttacgctttcagggtttggattcatcattgttaatgttttgacagtcttgtacttaaatccaaccttagatcaagaacagccacgttgggcatacttttcgtatgcgttaggtctcttcttgtatcaaacgtttgatgcatgtgatggagcacatgcacgtcggacaggccaatcggggccgttgggtgaattgtttgatcattgtattgatgcattgaacactactctgtcaatgtttatattttgttctgtgtgtggcgttggatataaaccgatgatacttttcatccagttcgctttgttgtgcaacttctatttgagtacttgggaagaatatcatactcacaaactatttctaagtgaattcagtgggcctgtcgagggtattttgttgattgttgcgtctttcattatcacaggtatttatggaccacagaaagtttggcacagagagctatttgcgttccaattgtttgaacaggactttgtgttagaatctatgcatgtaatgttcttcttatcaggtatcggacttattttcaatatcttatctgccagaagaaatgtcgttgagcattacctcaagagctctggtactgcagaatcaaaaacagccaacatcaaggctgctgatagaggtttgctgccatttttcatttatttcgctaccgtgtttttaactgcattccttcagccaaagtttattgcactaccgttcatcatgagtattggcctaacgatggctttcactgttggtagaatcatcattggacatttaacagatcaagaattcccaatgaggcatccactcatgtttattccatctcttcaactgatcatatgctacgtatttgtttacggtttgaaatatgattctaacgccattgtcaatgacttgaactggtttgggttcggactaactttgggtattcacggaatgttcataacagaggtcatttatgaattcacaacatatttggatatctacgctctttccatcaagcatccgaagaaggttgagtaaatctctaacccccagaacttcaaaactcgatgtccataataatatgtcattattgctcacccaccatgacctgttataaaatcatgttcctttcactagttttttaaatcatttattcacttatatatacaagctgatacgtaagaaactcgtcaaaaatactcacacattctcatcattgcagagctattgctgttttcaattgtttttatgggactggccgaagaggggggggccagttattggtttgtcatttagcatatcagtattgaacaatacttccacttaaatggcagttgctggggcacctggagaagctggggaagcaccctcaccagcagccaaaatatcattagcatccttttgtagatcgaagctcttctccatttcaatcaattgttgttcggccaagattgacaaggatagaggaacacccaataacaatgcagaggtagtcacagcccacaataagttaccactcttagaaaacacactactgaatagagagacagttccgttgtacaaaaaagagatggtctttctcttttgaggtgggataatatccttcaaggcaatcaatctttcatagatattttcatcttcataaaggtcctcatcatcgctggagaactcctcttcatcagattcatctgcttgttgaagagaatcgacagctggatcagcaagagtttccccagctgtggtttggttaataggggattcttcagtcaactcagttaattccaccattatttatattttcttggtatatgtatatttgggtactatgataaaggtaagcaacggctgtaacgaaacaacccgtaccataaagcaatcattaagcatctctcttcttcttttaaactagcatttcagttttcacgcttttcgttttgttcgattttttcaatgggagaaagacatcacctacgtactatgtgattagcagggtaacgctgttttccatcggtcataacctgcaagatgacaagacggtcagccattagacaagcgttggtttaacgatgataaaaggattgggtatatttaccatatatgtatattttattctattttacagcatttattttttacctttcttcttgaacttcctggatggtgccatctcttcgttgagaatttgttctgcactttcttgttttctcttcttgccggacttgatggccacagttccttgggatttgacagcttttgacaattctttggaagattcttcccagccctcgccagtttcatcaatttcatatttatttaggttcaaggaattgatcaattctttctgcttttctctcattgcgctgatagcttcgttccctgcattttcaaggtcatcttccattttgtcaatgacttcggcagcattgtaagacaacacttcttcgccattcatttcggcaatttcttggtccttgatttgaggtaaggttttttcaatagactcgcttaaaacttccctgaagaaattggtgaatttcctgataatcttggagaacatggcaatagtttgattggatggtaagttcaactctttcgttatgtcatcaatgcccttgtgttgcaaaccaattgcaagtagtatacacgattgtacgcttgataatgatacaccgtcacccagctttccactaaagtatagcaatgccatcattggtagaagatcaacaatgacatgataatccagtaagttgttagcatagctttctaacctctttagatcgaatggagaaaagatggaatccaattggtcccttgttaaaaccttattctggaacgatctgccctccgagtcttggtctagtgtttcacccttcttagcagattcaatgacatttaacgcttcgatggcagtgaatttcttaaagtcgaacgataataaagacaagaatcttttatggaaatctttggcaaattctgccagccattttgattcacgaccttcaagaactttaaccataacacatgtatgttcaccagtcaaatcattcgctgtttgacgtaagtaaactgggacaaatccgttgtttttccagaacttatgtaaagattttgttaaaccatatgaaacacctaagtaatgcaaaaagtgaggggtttgttctgagagtttcagaagcaatggtggcaacgtctttgcatcccttaatttgatttcatctttcaagaggtctgctttcttcaaatccctgtcatcgactctcttgattgtgtagtccttttgtaccgtatcttcattcaaatcggtgaatttaccttcgaaatgatctttcaataactccagagccctagacccataacccatagaggcgtattccggattggttgcaatcctaacaacacgggcaccactcaaaccggcaaattcttcatcttgaaattgctgtgagattagccatggaattaagtcaccaccagctctttgacctcttgccaaagaatttctgacagaatccttcgagatctcaccttccaatgcgacctggatgaccactaagggatcaggtattctgccgccatcttttggatcgatgggaggcaataaaacgaatagttgatgagcaggtgcatcactcattaattgcaagtcgttaggagaattcttgtaatgcgatgcgacataaagagccatcatcttctccagaaaattttcagaaacaggatgataagaaaatagagtatctctattgacgatgaataaattacattgagatggatgaggtgtgcctctagcagcaaatcttggatttttgattagttgaacgtccaaacaaagtaatttattcaaccatttttcaactgggtcaccaggagcgtatctgataggttcatctaagacaacttctctcaaagaacggccacttgtttgaacttcttgtttctttgaatctctggaaacaagtgctgtttcggaatcttcacggccagtaccgttggattgagttcttagctgttgaatcaatttcaaagacaaagatctaccggtaccttcataaccgttaatagtggatgccataaacactaagtacggacccaaaagcttctttacaagtggtagtggaattgcggcagcttcatcaatgacaacaagttctgcctgtcccaacacatgagaatcatttggaataatatattgaatggtctgtctatgttctctcttgatgtctactctgactatggctttgttgaagcttggattggtggactgaatgatatcataatcaatgtgctcctgatagcctagagcgtcaaatcctttgaaaataaactcaaataaagtcttcaaattctcaggggaaggagatgttacaaagatattggagtaaccatgggatacagcagcagcaatagaaatacctagagcagctgatttacctctacctctacctgccgtcaatgctacagttgaatttaaagttttctctgaaatggcatcaatgaaggtcaagattgcatgagcttgattaaccgtttttgaaagagcaactaatgatcccgcaggctgaacatcttctaaagacactttcaattcttttagttcttgattttttggtgaaatttcttcatcatcctttggtggaagtggttttacgttttttcctccagatataggtaaaacgtttaactcactatctactaccaaacagttttcattcgaacccaaggacaagataaatctttcgttgaatcttgccacgacatcgtcatgagcttccgttctataacgagagtggatatccatagtcatagtgtataactgttttagagaggaaatggactttaacatgataacaatgataccaccaccttcaacggtttcgatggttcttgctagcaaatttggagtcaaagcttcaaaatcttgtaggatacacataccataagtgttacccaaaattttttcagtttccttataataacagtatcgaatgttttggttagagatgaaagtttcaaaaggatcttgttcatttatctctctggtacctctcttgatctctttcttaatctttgcttctctcttcttcctgtgtgaagtgaaacccaagagtttcttcttatacgtccataacacggatttattcattttgaggtcagcactcatcattaaatagtgcaagttcggtagctggttacgagcattgtcaccaacgataacgaaaaatgatctctgatttgtttgaacaccatttctgatgagagctgggatacgagaatcaatagcttttttacccatcgtaatctaacttctggtttaaagttttaagaacacactctttaacaacaaacaatgacagttacgtttcgctggaagttcgaccgttgggaagagttagtgtttttaatgattttttttgtagtaacgaagtacagtaatcaggtattttggggagaaataaacgtctcgtaatactcagatagcttctcagcaaaccacctcatctcatttgatctcatctcatctcgaaataaaattcctacctaatacgatgaaatagtaaaaagacaatgaaaaaaaaaaaaaaaaattaggcagagaaaagaaaagatactacttacccggaattatttgatgaaaatatactgttacccgcatgaatttcatgcgcagtgtaatttcggcggctaatttcaagaaatgactacgtgtgcataatgcaccattatgtgatgtcgactaatattttaaattcatatttaaacttcagtagtagttttcatgggtattaattaaagttttcttcatgactgacgaaaagggaaaaactaacattatataaataccagtatttttgtgtcacaaggaataagggcaatattcttatgaaatagatccgatgaataagataagaggttaagaactgacatcagaacgaggttcgattataaggttgtttctttacctgaacaagcgcagttgtggttatctcttatacggaacgtacgattcctaggttttattttggttttattttttcgtggtcattcaggtaagctcggcggttattccatagcaatagccaggaggagagtgagagctaactatattttcttttaataggaacagagtatagttttatgtgatcaaacttgctatgatggaggatttggaccatctgaacgatgagaatatcaatatagatgagaacgaatttttggaaacacttgataatgctgacggggacgtgatcaaaacttttaggaacgctgacgggtcattaagtagtcattttgacaagagaaaagttcgtattgctccaaggtcaacattgcagttcaaaataggcccaggctttacgccagtggtgcccaatcacaagatattgaacgattttggacagattcaagaaatcaaattggagcctcggattgatcgagggtttgatttcatagatgacgattggattggttataaaagaaattatttcaccgtggtaacttcatttgacacaccggggactgatcatatcgagttcatgaaacaagcgtatcatttagataacggtgtggagatcaaatacttcgctaccaaattagccgccaagtgtttggaagatgataaattgattaacctagttcaacacactgcaaagcgagataaaggccctcaatttgctcctccaatacatgttattgcacctgcaaatttgccgaagcaccagattataagagatgcatcgaacgtgagaaacgaatccaagatgaaaaaatttgatagctattttttccttcataaagaagacgttggaacaggatgtgaagtaaggagtgtcttggcaaactacccatcggatccaatcaaaaaagtagcaaggtatgaaaggatacagttcgcctcttctataactttgaagaaaactagccaacaaaatagacggttttcacttttagtggttttaggctgctatgtgaagggaagacatgacggtattcagcagtcatcaccttatcatgaattggatcattatgatgaagagactgacatgacgtttgttccaattctaatggagaagacgccgcctctcataataagaggaagatctccctctaactattgccaacaaatcaaagtcatgcataccaagaaatcagattttgataatggttccccacaagaaaacgatcttgatgtgccagctgataagaaagagcggaaaaggcgaggacgaaaaagtaagcaaccagatcttaaaactactgcaaatgtgtctcacgatagcgctggtcgaatcccaacacttctaaccaatggattgccgtccacattcgaaatatcaccgactagtggtaacatgagaattaagaatatacaactgcactcgtcaagcactgagacctcatttccaagaggtttccaatctgagtcattgtcagtagcatatttcagtaacagtgccactcccatacaagactcgatttttaagaagagaagacttaatattagtaaacctgttgtactggagtcaaaccttgaagaaccgctggatgacattacagaaaatatctttaatacaatatcttttgaggaaaggactccatcgaaagaaaacaaagagcgattatcttctacaagcgtattcctcctgaagcatgtgacttacgatgtttcagagcctcctgcggtggcaattcccagggccatgcttccaaacaagatggaaatttcctactgtttgaatgattattcatcaagttttatcgaatatccacctcctagtacgtcacataaaagattgcctggttcgagaaggctcttaacagcctccggaaacccttcggatctattaaaccctgcagactggtcggatgggccgagcatcttccgtcattaatagctttcgccttataaacaaccgcaactgttatccgtagcgtagacaaatgatgctgcaaacagttctggcaaggagggatgtattttggagagacagacggaatgggtaatcttacttgcgttaatttccgaacttgaaaacagacgtctctcatttttccatgaaaaaacaataaattttacaatatagagagagagagaggcgctgacaaataaagccaggcaaactaaacgaacgttcaccagaacatgtcagacatcttgaattcaattttttgttagctaattggtttcagacagaattttctttgcatattctcacggagttaatacagccaaagattactatcccaaatcacagatggcggataacccgaaagccccaacgttcatcaaggagggttctggagatttggaaagccaaaggagaaacgagcaagtcaatcgagaagttggcgaattggttacaagaaagtcgctcagcgatcaattgagagaaaattccaagaagaaacgccaacaatttcagagacagacaaaggaaaagaacagcttcacgagagtgtcaaacgatgacttagatcatatcaataaggtaaagctggatgaattggaaaagcttcgaaatttttcgcagtgggctgaatctgaggagcgtaatcgtcggaaacagctgcaattattgcagcaaccttctacaccggagcacactaacaaacaggtgatttccaagaacgatcctattccaacctccattaaagtacgaaaactaaaaacgtccaatggcgcaaagaatgcgctaggtgtgattagtaaaccaaaacataagaaaactgacagaacccaaaaaaagtagcgaaagcaaaaattgtggtttcaaatttcggcggtaatccgaatgaaactggttgtggaacttaatcgattttcttttccccccccccccctaattctgggcctaaaagaaaaaaataaaaaaaaaaggcttgagtacttgaaaactatattattattaatcagtgcattgttttgaagcttaatactaccgggtacccttttagggtgaaattcacataactaaggattgcgcttttagtaaaacgaaccgagtataaaagaacctgtttagacgttagttagttccttgccaatcaattgattcacagtttctagggtgatgtatttcttatgttttatttattagtttatactggatataaccaagaaagactcgcatatctacaaaatcctcgaaagataagaataactaatgtcagttccaaccactcaaaaagccgtcatcattgaaggtgacaaagctgttgttaaaacagatgtctcagttccagaattaaaggagggtacagccttggtgaaggttgaggctgttgctggtaacccaactgattggaagcatattgcttataagattggtccagaaggttcaattctaggatgtgacattgctggtacagttgtcaaacttggaccaaatgctagtactgacttgaaggttggagataccggtttcggttttgttcacggtgcttcccaaacagatcctaaaaatggtgcatttgctgaatatgccagggtttatccacctttgttttacaagagtaacttaactcactcaactgctgatgaaatttctgaaggccctgtgaagaacttcgaatctgctgcatcattgccagtttcgttgacaactgctggtgttagtttgtgtcatcacttgggctcaaaaatggaatggcacccatctaccccgcaacatactcatccattattgatttggggtggtgctacagcagtgggtcaacaactaatccaagttgccaaacatatcaatgcttatactaagattgtaactgttgcttctaaaaagcatgaaaagcttttaaagtcttatggtgctgatgatgtctttgactatcatgatgcaggcgttattgagcagatcaaatcgaagtatccaaacctgcaacatgttattgacgctgtgggaagcgaagatagtatccccgaggcctataaagtcacagcagatagtctacctgccacattattagaagtggttccaatgaccattgaaagcattcctgaagaaatcagaaaagataatgttaaaattgatattactttgttgtatcgtgcatctggtcaagaaattctattgggtgcaacaagatttcctgctagtccagaatatcatgaagccacagttaaattcgttaagtttataaatccacaccttaacaacggtgatatccatcatatgaatattaaagttttcagcaacggcttagatgatgtcccagctctcactgaaggtataaaagaaggtaaaaacaaaaatgttaagtatgttgccaggttataagccgatactgaaaagtacgtatagctctacttttatgcgaaatatgttacgaacaattttatgaagtttagaacagaaaacacatcctctctcttaagttattggagctttttcgagattgatctcactgccggtaacatttacaagggattgtatcatatgtgtatataaactataatctaaaaatgtttatctcaagacgaactaaaaatagttttattataataaaactgtgaaaggtgatttgatataccaagctatggccagaatcgtcctctcactcgaaaccataaatgggaaactaggatttaattatagatacgcatctcgatcgacccaattataacattgattggtaaaagaggtatcaagactgaagaacatatagtacagttatcttagtattgatattcttaatgatcattgatcgaagaacaaagtacatccaacgttattgtcagatttaatagtagaaaagatgtgtgtcagatacacatgcagctgttattgcgacttataacaacatggcaccaacaacagctaaaccggctccgacaatgttactgtccaaaatgccagcaccgttttcagtgtaggggattggggtagtttcattggttggggcaaggtgatgagtagttaccggtttggtttcagttgttggataatcggtaggaataactggttttgtttcagtagttggacagtcagtagtagtaatgatagttttgtttttagaaacccaggtataagtctttggtggcattgggtaagaagaggtactgttatggtgtggtggtggagctgggtaagtggaagttttgttgtaatgtgtcggaacctcagaagtagtttcgcaaggaatctccgacgtaacggtgtaagtctgatgactggttgtaacattagatgtaactttgtatttggtggagatttcaatgctgcttttaccctcagtggtggttaaggtctcagtcttgttagatggatattcagacttcgtagttggatattcagacttcgtggtcaaggtctcagtcttgtttgttggatattcagacttcgtcgttggatattcaggcttagtggtggggtacttagacttcgtagtggagtacttggacttggtagttgagtaatcagacttggtagttgagtaatcagacttggtagttgagtaatcagacttggtagttgagtaatcagacttggtggttgaaatttcagtggtctttttgtgttccttgtcatgtttggaactgctccattttggtttactgtaatcttcatcatcatcagagtgcttaccggcacgcacaacactcaaggtggttaaagcgacagcagcaatagtagaaaatttcattatttggaatggatagatggccttgtgtttggttattcgtagtcacgagaagctgtgccacgaaagtccattagaatatcttataactgtcattaatgtaatgtaaccgaaagtgaagggatttatgccctaaaaatgtgtcaatttatataaaatcaaaaaacagcaataatagaggtactgcattccctgcaattgtacaaaaagttatgcaatgtcatcacttaagaaacggatttcttgtgtgtattgcaatcaaatctgttacggctttttaaggttttcctctgacgctgacaccggttttcaatttttttttgttttggcaaatttaagaaactgacacgcgacagcaaaaagaaaataatcaactgaggtcgattaagggttcaattgcaaataaatcttgcacgagaccagatggaaaggagaaaccgtcaggacaacttttacttcttgtgaattcaatttttttgctatagaccgattattttgaaacgttactatactttcagtattacttctaatggaaggcagtcacgtccaaagaaatggagggtactatgagtccggttttgaaatcaagtaagctccattattaaactactttcgtatttctcagtataaagattatgcgacttccagttgttgtcatattcatataaactgttgttcttggaggggaataatttaccttatgagccttgaagcttaatttgagttacaaaatattaatgtaaaattaagaaaacaaccaatgatgaattacataaatcataacgattgttccaaatgttaatgcattgcgacggagacaaccaatctgctgggaagcagcatctcgaaatacttaattgacaaaagtggtaccgatcaaagcacagtcagaaaaatgggctgtacatgttttcttgttctctatagaatccttgcatttcgctgatattgcaataaatgctttaggcgtggaaaaattaacaacactcaaataaaaaagtactgttattacttatgcctttgatgcaggttttctttgttaataatgcaaatcgttggaatgatgatcctgccgagcttaatgtttcttgtgacgaatttcataatgtaccaatatgttcattgttacccgccctcgatattttcctcattgattgatcacctgactaaaatatcaaaacttgagcttttgccatgtgaaaattaaaaatatcgaaacagttccgaaaataaggtacttgtcgctccatcatactaaagtgttcaaacagctaagtaatcgaacaagaccaacgataaactgaacttattagggaaccttgtgctttctttatctgcagagaggcttcaggatttaaacttcgactttgctaatagtattaaccgtgccttctataccgataggaggaagtgacgtaaaactctagcataatggcaacgtcaccgagtaccacaactggaaaggatatcaaaaagaaatctgaacgtcgatcgggccctaggtttgatcctgctgaacagcggtggaaacatgtctcctgtgagaagaatagacgatcatcgataagaggatcctatgacaaattggtagatttggttcctggcttatcagaaaaggaacgtcgatctgaatggaaaatatacgtgaaaagtatgtatcagtcattggagcattgacctacgcaaaaaaaattctcagacggaccattgtactaacaaatatgtttaacgactattcaggccgacattacctgctgtggctatatgctaggaataaacatctacgacagaagttaaacgagttaaacagagagtatcccgcacatttatttctggagagacatgacagcggctgtgagcgtaatagctaagtagaatcaggctccaaacaaaacatattccttagcattccaatgcaaagatgtacgtatgtaataactcatcaatcctggtaaatattctctcaaccataatgtctatattcttctgtaaagcgctaactttccagtaaaaaaattagtgcgagagattcaaaaaaaaaacgaccccggagaggattgaactctcgatcttgcgattaacagtcgcacgccttaaccagcttggccacggagtctaacttgttaaacaggaaaagagtcggtgccatcagtaccacaaagatgctctattgggccaaatatgactatatatatttacggcccttcaatgttatcaaaagatactaaaagaaaccaagcagagtacaaatcaaagttgcgaaaggtcataaatcgattgataaggtacataaagcataaaatatatctaaattatgaatagtaagaaaaaacacaagttgcagaagcctaccatttcaagatgaccatattcttggtgccctttgttttgataccatcggtgatcaattgtaaaacttcttcgtccgaggcattgttgacgtcccattcgagtgcacggatgtcttctttaggagagatgattttaccatcacggtacaactcaataacttcattcacagtcttgattttattttcagggtctctcttagagttctcagtaacccagaagccatgagattttaatcctttaaaaatgaacaaccctgttgggaaagtcaatggttgctttgacataccaccgtaagtcaacattaaaccatcctttgacaatttacgagctatgttagcacatgatttacctccaacggagttcaatgctaatttgacctgagcgtttgaccccaaaacttttggtagaacttctttaccaaattctttttcgccattctcagtttctgaaataactttggtagctccatacttcttttccaatatttctgccacttcttcaaagttttcacgatctctgatgacacttaaggtgttaatattctttgcctttgcgatttgcgtaacaatcttagaaacagaagaagttccagcattctgaactagccaatcattaccttttggatcccagttgatgtaatcattaaccaactgataagcggtgcatccattaacggcaacagtagctgctgtgtagatatcgacaccttctatcttgatcaagtcagattctttgtcacacgttctgtaggtggaccaggttccgaaattagcttgcaatggaataactttatcaccgggtttcaaagtgcttacactggatggtaccgaaaccacttcgaaaacaccttcattaccggcaatcgcagaaggctcgtcagtggaataatctgtaactttatctggctttgatggataaacaccttccaactgattgatatcggagggattaatcgggaaagctagtgttttcaatacgatcgaagtttcgctccctttctttggtttgtaattatgaactttcaagactttagtacaatcctgagaatcatgactggaataaatcaatgatttgaattttaaggattcttgtgacatggctctttgagagaatgaaaggaatctctttgataggaatgaactcatctgaggaatgatttggctgtaaaagttttgacaatgacactaaacgaaaagaaatagagtataccactatggaatgactactgaaactggtgtatattttaacggccaatagtattactcatacggttcgagcctcaactatttatactcgaaaacgtctcggacctatgcttcttactaactttcttttgttcgctcaatattcaatgaccttactccacatctagataggcaaataccctttttttagttttttttttcagaagtgtgtttgctagagttattttgcacttttctgccattggaaccgcaccagaagcatctcgtaaaagaaccaaggccaatactgagggtcaaggtttcaacaaaccggagtaatgagggaaaaagaagatgtcacgtgaacaatgcggctctaagtgggtgatgataatcgtctgagttttttgatttagatgacacaaaaagcagatacatgaagcagtcaaaatttacagacagttccaaggcttgtttggatgccttgaataaaatcagagagttatagttgtatattttgtcttttatttaggagatgaaagtgtttatatacatactactttaattagtttgaaggtgcacattggtgttacagaggtctggtgccaacgggatactgatgagtgaagctcacgaagaactgttttcccatgtggacagcttcaaatattccacgcgatccttaatatatttacacatgtttttcacttcttgctctggtttttccgttgcaccgatgacttcgctcaagtacgaaaagttcaaataatcatctggatttttgcataaaacatcatcgaacaatttccaattagctagttcaaggtcatagttggttaggtctttgaatgtcggagagtacatcctatggtgccctttaccattgggtacatatttagatggatcgtccatcttcttagtagccttcttaccatcatacaatagatctccagagatggatagttcccatgggttgtacttagggaggtttgaatgaagaaaaactggtgttgtaaattggaaaatagtgaagaagtcttttattgtgtatttgcccttcatgctatcccaaaatttatctgaaacctctgacatcttcgaaactttctccaaagcatccttttcattcatatctttgaactcacttttgtggttctttatatattccaatctatgtgcctttaatttgttattgacagaaccacggattgcatctcttgcgatactgtcaaaggtcctgtcctcattataatcatgttgaatcatagcaataccacggtattttttttcatttgatggagtatcgtcaactaaatcatcttgaattctgacttcgttctctattttcccccagtagccttgaggacgtaccggcgttctaacctgatagtatctgtgcttcaacacagttgccgccaaaataaatgtatccttgtcaccttccccggaaataccttgtcctagtaatctataatagtaggaaggtccattgtagttgtaatacagagataaaattagagcatccaaatgactagctttattaacaagcaactgaccagactctgtactaccgtctgggatcgctccttctaaatcatggaatggaatctttgcgggatcggactctgggaacagccttgaattggtgatatagtctgtgctgtagcgagccagcttatcctggaccttaatgtccacaatatcgtacaattttggactgtgaacccttctccaataatctggccacaaaataagccctgtttcacggaagatatcaccatcaaagaaattacccaatgagttgatgacataattgtctgcatctaataatagcaccttttcaaagctagaaatcaacagagacaatgatttcaattggtaacctgtgatatcttttaaaatttcagaatcaaaaaattctgacaaatagacacacttcgtcaaacctgaagggtcgatggtaggaattatgttttcacaaacttttctatcagcattatcagagggtggaataacgatttcaattgggacactacttttcaatgttaaaccgctattcattctgatagatttgataaccggaagagccatcaaagtgtatttacccccaccaacaatggaaataccctcacccttatagactgggtccttttcagtgtttagctttttgaaattcggcatgagtttatcttgtaaaagtttcttgaaattattgtgagcctcttttacttccttcacgtcctcatcagaaattggcaaacacttcagaaggttatctttagttaaggttgaaagcttttcagagtccgtgttttcgacaccagtgtcggaaagtttacaaccctcaggcttcttaacttctaatttacctttcaatgctgtttccttcaatgtggtcataatttcctgatagaaatctttcaggtcactgctaattgtgacaccattactgactgcattactggatgtaagttcagaagaaacttgacctccagagttcgaattagctgtcgatgagtcaggaagtagattggaaaaaccactacctccattataaccttctccaatagtgtcagaaccaaacccagagctaatatcgtataattgcttgatactatcaccaccgaagacagagaagactatgatgacaaaaaagaccgccaggatcacacagttatgtctcttcataattcttgctcttcttgagaagtaatgcagcgactgtttccatttcgaggaaaacgttcccccaactgaattcgtcatcaaagattatattttatgaaaagagttcttcaaacaggattaaactgatcttaggatcagtgaacttatttcgttaaaatttgatgtgattgtggggtctcgttgttacaaaatctttctaaaacaattgaattacgtgaacagaaaatattcagaccgatttgaatatgttatatttaactcgattcaaaaggctccattgtatttttcttgataactagaagctttgaattgccgagtgatcagagaatagtgaaaaatcaaaatgaagcaaagcacgtgatgtccgggtaatgtcattcctcaaaccaccacacaatttggcgtcaccaaagaacgtcagtttagggttgcaggcatctccatattctagtaggaaaaaacagtcccaatcttcaacttttcagttagaaattatcaactcaattgttacttgcccagccaactataacggggtaactaaaaattgcctttttttcttcatttagggacttgttaccgtcaggctgacacaaataacacgcattgaatatttgacgtctcgaatggaaaatcaccactgtccgattattagggtctaaatactctgcatattggaatgattctctgaaattatttccaataaaatttgctgagatttatttttatatcctatgaacaaacgatcaattcaggtgtcgatttagtattgagatctcattattattgatgaattgattagatttggacagaagcaagaagtccaacgaatagccaaataattatccagaatggcggataaagttagcttcacaaaaaggaaattgataaaatattcctcaatgatttgcggttctttggaagaatgcggcgagttagatttgacggatggagatttagaggatatattagtaccacaaagtagagataattgtgctgctgagaattggaatggtgcaaataactacacccattcaatttcacctgctgattatattatcgaaagaaaactcctttctccaaacatgactggttggcagtggcaggcgaataaacagaaaatgcttgaatctgagattcttaaattgattgagcaagaaaaaccggaagatcatttgaaaagattcacacggtcgactaaaaaaaaagattctcaacaagatgaaccagtcagtcctatttccatcagcggtagcgaacaatttgatattaaacatcactttttgaacacccctccagaaacagaaagatctctgacactggtattatctgaaatgattgtctctaaagaatatgtatagtttcccctaaataagaagttattaagtggtatcatcataccaatatctatatatagtacataaggttatccgagtaatcgtatgagttcagataacttaaaatttagtcggcaagggctgtaaagtatggaatggtttctttaaaagtgtctttccaagtagctccgactagcaacataactaaaccccttaaaataatccgtagatcctgcaaaggcggattctttcgttgcacgagggttgttaatctctatgccattatcataaatactggtgtctagccttttctccgtaaattctgtatcaaagttttcagcaagttcccaatcagtgattatcggtaagataggtcctactgaaatcttttgcaggtcaccgcttaaaagctgtttccagattattttcctgaaaatgaaatgaccaatataattagtcgttttagcttgaccagctttctttttcttcgttttaggaccatcttgggcccaatatttatcaacatcccatctttttgtgggatcttttctcaacaatgcaccgagataatctttgaatccatcgcttaagtaacttggtattctagcaccagttttctcttgcttaattttgtttaatataattttatggttaactcctgtaaatggtggtttaccaattagcatatcgtatactaggcaacctaaagagtaccagtcacaattctgagtgtaaggttctcctgctaatatctctggagcacagtattctggagtacctataatggaataaagctgatttacgttctctccttcttctggtgtggcagcatcatcaaaaacacttttcttggataatccaaaatcagtcaacactagatgtcctctttcatttaatagacagttttctggtttcaagtctctgtaaactattcccttagaatgcaaaaattttagagcacaactcaattctgcagcataaaacgcaactgtaccttcatccaaggttccctgttcttttaaatgataaaagagctctccaccaggaatgtattgtagtaccaagtacaatttatgattgtcgtggaacgaatagaacaatttcactatattgggatgttctaactgcgataatatagtccgctcagcaaatgtcctttctatcctcttttcaactgtagtattggcgtccttttctatagagtcttccgaaattaaaatttcagccttcttcaattgtttcatggcatacaatttcgatgacagtgagtccttcaccaatagcacttttccgtaagcgccttctcctaggcatctaattggtacaaaatcatccaatactcttggtgccccagtcttagagaagctggatgctctaagttgtctggtttcttcgaccgaagaaaccgagagtacatctcgagtttccttatcactatctccttgagcattcaatgataacctaatcgtatgctgagcaggattcactacgaatttattgtagagggaggacctcctcctagctggttccttcgtctgagattgcttggactcaccagaatctggtggtactaaaaagcctgacatcatttcggcttgttcttctgtatctgaaattagtgcctcttcttcgtatgtattcggtggtaaagcagataaatccatacggaattggttcttgtgcaagggcaaattcatagtacttaagccagatgccggttgaacctcattatcaaacgaatccctatcatcatcctgagatccatcatctataatggcacatgtatcattcactctaagtaatttgaagtcttcatcgaaactaaaaagtggcatctcgtattatctcaattcaactacaatagaagactttagtagcattcctcagtatgatttgttagtatttgattctgtttagtaagctctgtccgggacctgtgaagaactaatttcttgtgatgattacgagtgatacacgttttaatgcatgcgatattactaccttttttttttttttttttttcaatctcttgaaaagttcagaataaaacatgcactctgccgcccgtaactttttaactggtcattccgtggataaaagattctggtttaactgtaaacaaaatctaagatataatagatgtatcaagctgttgaaaacttgatgagatacatatagatacataggatatttcataaatatagtttgtgaggtaacgaaatgaaacggtggaagaagcaatctaacgttttcatgaaaaaatgcaagtccgaaaatttatacatcatgtaatttgcaggcagtgtgggatattcttcttgaatatgatattggctcaaagtgtcctgaaagagcgcttcataggatacaatgctctttcataagttaggatagtaagtttggttaattagatattgtacaagtccgtgatcttttcgtaaacatctttgttcattactccgttgtcatatagagctttgtttagcgtgtggatcaattcaatgatttgattagtatctagattcattaggatagtagacacaaccgtgccaactgtgattctgttttcgctaatgaaagtttcgtaatacaagttcatgaaagaacccatcaaaaattggcaatcgactctatcagtaataccaccgtgacccggaattgaatcaccaaagtccttcacttggaatgtcctcttcaatccagacgcaaagaaacccccaaatggtgcaaataaggatgcgaaagtggccaagttcaatgcatgcaaatagaccggtttgatagtaataacgtcaacgccaatcttttcaaaaataatcggaggtagtctataatcctgtggaacgaaaacagggttcaactcacaactcaacgctgtgaaaaagtttgttttcaagtctgtaactggacatgtcatgtagtaatatggtgcaagaagtctggtcagtaaaacactggcaattgcagtgaaaaaccatgcgccgaggaaaccctctaaagttttctttggagagatttcaattagtttggtacgaccaaaagttataccacataagtaagcaaatatatcgttcacgatgaccaagccgcatggcaaaaggaaccagatcaaaccgttcaaaacattgttgatgatcaaatgtgcttgaaaaaccaccaacagcaaaaccatatgtgtcacacacaatgaagcaaattggaattttaggtaaccttttctcaaactgcaaacgaatataacaaaacccaaaacatagagacaataactaatgaacttgtgattggatgccacgaaattcaaaacggtatacttcacgaaggtatcgttgaagaacttgaaaagtgatttaccgtccaaatagtatatcgtagtaaacaaaaagtaccagttcaaagttttcgttaaagggaggtttttttcacgtcctgattgtccagtaactgcaatgcattctttgaaagtggcaatttggcaacccaaaatcaagacaacacaccaaaagtgaccagaagccaagatgataaaaaaacctgcaatcataacaaatgtccaaatggttctaacagcaaaattatatagttttgaatcttttttgacttcaaccttggagtgttttttgtaatcttcaactaaccgtgttctcgatgttgtttctcgatgttgtttctgaggtgttgaggttgcagatccaccacgggaggtgttaccagttctttttttgactgtcatcacttttatattcccggttagcagattgtaacgtgcttagatcaataagatgctgtgaagtagagatctgtttccttactcatgcgagtgatgatgctcttcttttttcttggttgattatatatttccaccatctattccaaatggataattttcttcgaacttcaagatcatgtgacatgtgaaaaaaaaaccatgctcccaacttgtgtaaagttcctctacatacatacgatatttacagatgcagcaataagggagagtctttccattttagcatgtgtgtaggattgaaaggtcagagaaggccctgtttcttaagttcttcgtatacttgaacactcatcacattaccttcattgtcctctgtttcaagtaccatttccggttctttcacagttgatattttggaaaagggttcacctgactttagtgtactctttgcttgcaatgctttccatagctctgtcacctctactatagtagtgacatctttgaatgcaagagaaggagttatgcctaaagatttcaaaccttctgaatgttttttcagtgggaaatgtttctcgaattctctacgcccatgatatatttgattaccgcagatctcgcaaacatatttcacatctaaaccttggactttgatgagccagcgaggtataggaaatccgtcaggtcctaatggtaggttgtatggattcgttggatccatactctctttttgagcagtatcttcagcattgtcaatataagatggtttatcttcagattcatctttggcgtatatgggtgattcatattgttcttgtagcttttccagctcttcagtaaactcttcatctgtgaatgcaagttttctttccgtgaatgatattgtattttgcaatactttagagagaaatttggaaaaacagtgaaacgtgtattccttcatcaaacgctttctattccgagacaatgcaatattaaactgttcagtttgaacatgagtattaaattccgactgactatcaaaccatcgattaaacacaacggagtacattttcccgctttccttcgatggggattctgtgataccggtcctcacatatttatcaaatccattgtggatggttttggaaagaatttccttgtccactagaggataagctttggagtaataggccttataatatttcagtaactcagtgactaattggttatattccttggtgtctctatctaatgatgggttgagtaagtagtcgtatgtttcaaatgattctaacatcttcaaaaatgaaagtatcgttaaatccgcacgcttgatgatattcaaccacttcttgaattgttctgagagatccaaatacgtcccaaagttttcatctctagcaaagtttcttgaaagatcaattatttgtcctatgggcgatatgatgttcttactggcagcttgagggccagaaaacatctcatagtcagatttgacttcaaccagagaacgtgagtttacttgaccctctaatacttctgtggtgacggtttcaaactgttcaaagctagcgtttgtatccctaaagtattctaaatgttcttcactcaatttgtgcttttgcaaagatttcaacagtcttctatatcttccaagaaataaggcgatttcatattcttgtgctttgatttgctttctagaacgtttgcttttcttgctcctgtaaatcctgttggcagaaacgtctagcttaggtaccgcccaagcttcaactcccagattatgcagtgcttcgttaaatctgtaaaagatttctggatttcttcgtagtctggacgaaatagcatcctcgatgacttctaattcttctaatatctttcgcctctcttcaaaacatagataagtgggggcattcatatctattgtcttctatgaatcctctaactgctacacagacagtaaaccgaaggcacggtattcattttgagccttcatctgatccatatttgtactttctaaggtatttccattctttacatttttattttctataatcaatggcaatttcgacgtatgaggaacaaatactagtaaacaatgtaaaccagcaatacaatatgtcacatatcataacaataatttggagagaggccatttcatgtttaagcttagaaaatgtctattcaattacacactgattgttatttgagcagttacataatatactaatgttttctccgcttcgtaggacgggcattcttggaacgctttttctctttaatttctcttagctttctaatctcgtcaactgactttatttcttgtttcatcccaggaccattataacccttaactctaacacctctttccaaagcagcttccacttttttcttttggaaagcgtaatcgtctctatgtttatcaggcaatttaggagctttttgagtcttgtgtttgaatttaccgccaaccgtacgctccgatggagaagtcggatcagccaatagattcgatggaatagtggattctcttgcaccaactttgagtggagcaatttttcttgccttagaccaatcttggaattttccggatctgaaacttgcaggaatcttttgaccactttctccgatgatgtactttttgttgtccaaaccttgagtgttcacatatttcttacgcttcttgtcccacttaaccgtagctgtttgcttgtgaacttgtaccttgtcatcgttggctagatcaaatgcagcattggaagcatcatttgtgaaaccagatgatatctgtaattgtttatcttgaatgtcactagttggtgcgaaatgtgatagataaaaagttggatctctgaaagttttcttctgcttcttcttaatattttcttgctcttctaacaagacatcggcatcttcaaattctttcaatacctcatcaggcactgagtaaccaacttcgttgtcttcacctttcaaaatttcatcttctatactatgcctcaaaccaatcattctctctttttccagaagttcttgtctttcttttgccttcctttgaattggagctatttgtctcctccttctcttcattaacacagacatttcatcgtctggattccttgcgaactcgaatacagtttccttgttatttctgtgttgcaacttagctaagaaatccaatttctctttttcggcgttcttaccgaagtatatattctgttcgtcccatcctgatctgagaatttcctttgaccttttcatggattcagcagacgctggtgtcctggttctaaagtaaagtttttcggctttcagggcaacacctttcacagtatttaactcaaagtcagatttgatcatattgctataaaggtcacccataccatcaatctcagaacgtggacaagcaccaaggaccattcttgtggtgtaagaaaccttaggatcggtgaaattattattaccctcagattctgccttctttctgagtatctggcacgacgattcatacatgggtgttaaaaggatcttcttacccaagaataattctagatccaagagataaggtagttcattttcagagacaatcgaaaaggcccaacctctattaccagctctggccgttctacctacacgatgaatgaaaatttttgaagaacctggcaaagagtaattaatcacattcgctaacaaaggaatgtcaacacctctggctgccacatctgtcacaaccaagatagatgttaaaccagctctaaaattatagagctgttgcttacgggcatgttgattcaaagcaccataaatatatgatactaggtatccacagttcttcaataactgtgtgacgtattcgacatgatgtcttgttggaacgaaaacgattgttgccttttcggatggcatttcgttcgcattcggtaagcgccttttggattttttagccttctttgccttctttttcttttcatcttcgctgtcatcactgtcagaatccgcatcattctgctgtttgagcttctttatttgggactccgtggcaacaggcatcttgatagcttcttgtaacagatataatagattggcttcacgttcatccttttttatagatataaataacatctccaaattttctgatatcttcgtttcagcatcaagtctaaccaatactgggtttgacaagcctgccttagcaaaatcaaccaatgatgatggcaatgttgccgaaaacaataatgtttgtctattagttgggaatgccacaagcagttcattcagttgttcctggaaacccatttcgaataatctatcagcttcatcaaatacaacatattcgactgatttcaaatccaagttcatttcaacttttaaatgcaagaatctacctggcgtagcaatgacgacgtcaggattccccatcatcataccgaattggtcttctaaagagtcaccacctgttaacaaaatagaacgtaaatccgagcctttcgaaaactctttgaaaactctatgagtttgaatggccaattctcttgatggtgataaaataacggctctaacaccaatcttggccgaatgggtctttaatttttctatcataggaagcacaaaagcagcagtcttacctgaaccggtacgtgccataccgacaatatcacgcttttgtaaaataaggggaatggttttcctttgaattggtgtaggttgcctgaaacctttcttcgagatattaatcaatactagttttgagagaccgaaacttgcaaacgaacctttcttatgtttagccgcagcatcagcggtagtgttgaaataatcgtttaagtcatcatccgattcattcgtagccttcttttcgtcgtccgaaagctcaagacttgggaacttactgtccacaatgggacctgccttgactttggctttcttgttttgtttctttggtttcttctctttctcttcctcatcactagaaaactcgataacatcttgaacttcagcttggaaaccaatattgtcattatcatcatcagaaatgtcactatcttcactatcagcatttaaagcaatatcaccagcaatgtcgaaagcatcctcatcttcggaggagtaatcttctgctgggagagctcttttgctagaatcaaccattactgttaaatttgattaacctgagttcgatatctaacagttgatttatggcaaacaatgattggccttataatcaatacgatataaaagaatatttagcactactgatattaatgagttactatctcatctcatctcatctcatcgcatctcttatttggaaagtgatgtattttcaaaattttcataaggaaaaagaaatagttttcaagaccggcataaacagaattaaacatcaaactgacgctttgtgtgaaaccaagaagatcaagtgacctaaaacaaaaacttcaacattatgtgtcacgaatattaccaaactcaagtaaatagaacgtcatactctaaaattttactataactatttcaacttgtttccctgaatttcgcctctgtacattatcttggtttttttttttctatgcaagccaatcaattcagtatctgacaaaaaaaagtacatgaagatcacaactataacttctcaaggtttactgaaataagtaccagctatatcttgttaaagcaccataaaagtgtcccgaaggagatgcaccactttatatagcagacggacagaagttgcgaggaataatgtcgaaaatcacttcaagattcttagaattatgcaaacaaagacggttgcctggatatcatgtccaatccatgccatctaaatttgataatattgtggtaggaatgtctggtggagtagattcttctgtatgtgctgcattattcgcagcttacccgaacgttcatggagtatatatgcaaaattggggcaaagatcaatcattgactagaccagaggaggatccatgttatgagaaagaatggaaggatgcagaaaaagtagcgaaacatttgaacatcccagtggagtttgtgaattttgagaaagattattggctaaatgtgttcgcgcctatgttagaacaatatagtatgggctatacaccaaatcctgacatcggttgcaatcagtttgttaaattcggaaagttgatggatcatctggatgtgaagttcggtaagaacaactactggttggtgatgggacattatgctcgaatactacgaagagatagtggtccagagagatctgaaccacacttgatgcgcggattgtatcaacagaaggatcaaagttattatttatcacaagtttctgttccttctttaaatcaaatgattttaccaattggtcacttgacgaaaccggaagttagagagatggccaaagaagtagatttacacactgccacaaaacccgactctcagggtatatgttttgtgaacaactcacagcatgggaagtttaagaatttcctaaaagaatatctacctatggaactaggaaacatcattaccatcgatgagctgactggtaagaagacggtgtggggaaagcatcctggaatctggtcctatacaattggtcagaaaattggaatatcacttcctcaaggtgatccaagatatcaaggcgcatggtatgtcagcgagaagaataaacgcacaagagaaatcgtaattgtcagaggaaaggataacaataatttgtttaaagacgtggtaacggttaaacacttcaaaatactctccaagaatccactatctaaagaagaattaaacgaagctataaataaagaaacgctacacatgcaatttagatccttacagaccccagtcaaagtaacatcagttgagtggataaattcgaatgaattttctttgaaactggagcgcaaagaaagagcaatggcacctggtcagtactgctgtttatatgtgaatgagagggtcattggaagtgggataatcgactgtgctcgatagtatactgcagtgtatgcgcctcaagctaaaatactcgtctatagaatcaaataacttgcattctaatcacgtgatatcatcatgtgtgtgaatcttttcaaatagaatcaccaacagccacatatggtcccagtcaggtgcaactgatattccaaagctataataaaagaactggaaagagagtgtaacaactgaaaagaattttggaaatagataatctccgccgttaagtatcttgagtacaacacagaatgttaaattagaggtattttttgtaatctacaatatagaactctactactctgactgaaaactaaacatatcgacaagggaaattcgtataatgtctggtcaatttgccaaggaacttgctgttgcaactcaagccgtccgcaaagcttcattgctaactaagagaattcaagcagatgttatatctagcagtaactctactataacaaaatctgatcaaagtcctgttaccatcggggactactcttgccaagctatcatcatcaatgccattaaatcaaacttcaaggatgatgctgttgtcggtgaagaatccagtgatggtttgacagattcttttatttctgagattttaactacaattcaggataacgacaaagtatactccgaagtttttgcagacgtcacacaacaagaggagaaagacgtcccttttgtcaatgaggaattccctctaaattccattgaagaaattaaaagagttattgattttggtaactattcaggtggaaacactggcagattttggtgcttggacccaatcgatggaacaaagggattcctaagaggtgaccaattcgcagtatgtttggccttggtagttgacggtgaagttcaaattggtgtcattgggtgccctaatttgaaactatcaaactacggagcctctgatttgagcgactcactatctgcaggttatattttcagagctgtgagaggacaaggtgctcaatattccattaccactgaatcacaatggagggaaattcataccagagatgttgaaaatacttctgacctggtttccctagaaggtgtcgaaaagggacattcgtctcacgacgaacaagctatcatcaagaaagatttaggtattactaagtcccaacatctggattctcaggtgaagtactgtttacttgcccttggattaggcgatctttacctccgtttaccaattaaaatgtcctatgccgagaaaatctgggaccatgctgcaggaaatgttattcttgaagaagctggcggaattcacactgacgcacttgaggatcaacgcttagactttggaaagggtagaactttgcaaaccaagggtgtcatcgcttcctgtggccctcagagcttacactcgagagtagtatctacatcagcacgcatcatttctgctagaaaaacttgaacgcatattattatcaaacacatacatcaggttatatcatagtatattttttcaagctacttaatgaaatgtagacgtaccttaaaccgatacccaaataatcaggcataccaccagtgcaacaagctgttgccaggtagagcttgttcctacaaccgatgagtttccagcctgctagcgcatgacgttagctatataaaaaaacccctacaatagcactacttaaccatagatagaaaatgtacatacgtacttaagttgaaattccacatagtcagtgtaacatattacccgatagttccaaattacttcaaaatcctgatcacaaactggcatccaggccacctttcccaaggaagctccttggcgttttcccacatgccggtgtgcattttcccataaacctacatataattgactgtgcctgaaattttcatcactgctattctggttgaataatatcgataagaaaaaaaaaagaaaatggttaataatttcaaatcatgacaattcaaaggactggacatgcaacgagaaacagcaggcaactaccataattgcaggaactggagcattatatatatgttcgagatttgtgcagttagacaagtgtttgacgtttattgacatttggagaacctttattctagagaaggagatagaaattttccatagacgttgccttgagagcgtaattatagcatcaaaagtttttgaaattgaacgacagagtagaagttcatcaaggtagatcaatacttgaggttcaagaacttgtgtattgagtacaggttaacaatcgctggccattgttaatctgcttgattagtttcaaacttcagtcctatttttttatcctttttccgctgcgaagagtgcgctggctgcacttctagttgctagacatattaaagtattggttctattagacgtttgctctcgcgatgattgaggatcttttagacccaactagcacgacggtggttacttacacacattatgccaggatcgctgcgttcaaggacctgaatacaacgaccgtgaatcaggtattgggattaccagggcttttttcaacattcaacgctccgcaacttcggaagctcaggatatccgcaatttctgcttctgtggcatctatcttcgcatgtataataggattatacctactaacatcgatagataggcgacggaaagtgttcagacatcatttaattttttaccttttagtttgtgactttttgaaagctattgtattattgatttatccagtggtaatattaagacacaatgaaatatatggaaccccagcattctacaatactgtaggatggctcactgcttatgctatcgagggagcagatattgccatttttgtctttgcgctgcatttcgccattcttatctttaagcccaactggaaatggagaaataataacacggggaatttggaagggggcttcttcaagtggagaaaattcatatacccattcactgctttgacaccgaccgtgttagctagtctagccttcattaatttcagcagttataacgaagatgtcatcgaagctgacaccaacgttgtgttagacaataacaattacaattttgaattccaagcaaagatggggggttataaacctttaagcgcatggtgttacttaccaccagttccaatatggtataaactagtcttgagctgggtgcctcgatattttatcttcttgacgatttgcacaatatacatcagcatctacgtctttgttaacagagaaagtcgaaagatcaaatcagaaatcaaaggattccaacactcggaagacaatcatgttaattttttcaacaggaagccatcacttaacattgctttgaatgtaataaatggttctgctattggaataaaatattgtttcaagagattcgtttcgtttttacgtaactttttctttctcgaattgtttgatgatactgaaagccaaaaacacaatttatcagcagcgggcggtcgacagcgtgctggcacgccaggcctaccttcagtgaatgatttggatatagggctatctaacagatatgagtatagcccagatgaggttgacattgaagacggatacaataataatagtaataacggtttacatttgtttgaatattctaatcttccgattgccagtcatgacggaagtgaagatttaaacaaaaatcgtaaaccagacagccttacaccagcgaaacctcaagttgctcagtttcggcaacccgctaactcctatgcttctgcaagatgtcctccgagcatcccattacaaacttcttcctctccgaatgatgtgcccaatgtgtcgaaacatagtacaaataccgttgataaccaagcgatgggaacagaagtggatattgaaaaaatggaacatcttccagggaaagatgtcacaggcataaagcataagttccaatctgaaatgtatgcgcattttaaaaatcggagggatcagattaggaggcaacttaaatcgatatttgtgtatcctatggcctatttattactttggctcttcccattcattgtagactgttctcagtacagctacgaaatctacaatggccctattgtatggttggcttacattgctacgttcatgcaaccgttgaatggtgttgttgacgtggcggttttcctgtacagggagcagccttggagatattcttggggtttaattcatttcaaagaactaatcagtaaatacaggctcaagggagaaatcggtgaggcagacatcttaagtatgtgcgaaagtgaacttggaagacgtggatggtactatagaggaagatgggtaaaagaagaatgctggaaatataaacctcagttatggaaacgtacatactggtatgtccacagaacagtaatcggattatggaggcttgatttgaatttcgaggacaactgcttagatagagattattgggattcgtattatggaaatcatgctagtaatacaatgtcaatgtctacaaccaacaagctcaagctgtttcctgtactgcatcaaagtttatcttcatcgacaggaagtagtgaaaacggcatagatccatataagaggaaattcaaagtgcctttaatgtggagaatctttcataaacttcctctacaagaaggtattgaccttgatgaattagatcgttatctcaagatgaaaaacagatatgacgactttattattccagggttgcaattcgcgattgaccagaatacgagcaacaacaataattctctatttaaacccaattaccttctttcgagcagttccaaggaaaaggaaccaacaagtgacatttctcctagtaaacattcctccatcaccgaaacaccattacaaggatcactcaattttggcaatgtggcaaatatgaactttgctgatgttactaagaatgctaatttgccaggcgtttgtgcgaactctaaccagtctcaatcgtccactaaagaggaacagttagatttattatccttcttgaaaggtccaccaccaacatagttcgtaatgcacattgaacataagtaccatatatattcagtttaatttcagttgattgatatatcgtttatcataaaatgcaccaaccgaattaggtaggctagtccttgttaagatttatatcattggctatcaacttttctagcattttccgtaaaaatatgataattaacacagcaatcttcaaatttaaaggttcaagatatacaaagggagagtcttttcacctattaacattctatctccctaacgggtacacttcttaaataaagacattgaagatgtcgagaacacttaaagtatttgctagttcattcaattgtgctaaggtgttcccatttgatgacatagatacacagaagtccatattagagcagttgatcccccatgtttcacaccatgatatctatatattagggtttcaagaattgatgtcgatatggcagggttcattttccaatatttgctttcaatatctcgaaggtctttcaaagctggtcttgaatcgaataaatacggaggaaacaacattcaaatgtgtggacataaactgcctgggagccattgggctaatggttttttgcaaggaagagctggaagtaacaaatatcttgaaaactaatgtgaaatgcggtgtgttttattctagtttgaaaggtgctagtgttatacggttctctatcctacatgagggcgttagtgacacaattacatgtgtaacctcccatttagctgccaatgaagggttgatcaatctggagaagcggattcaagactatcatgccataatgagttcccttaggaatgagttcggtgaaatggaactaagtcatgtcatattcaccggtgatttgaacttccgcttgaataagttcttcggagatgtagattacagggaccctgatataatctcgcaactattaaatgagaacgatgaattaagagatgtgatgaaatcagaaagagcgttcacccagtttcttgaacctagcatccagttcccaccaactttcaaatataacatctcttcaccaaaagatgacatcgctcaggatccgttatactataactttaaacgacagccgtcttggtgcgacagaatattgtattctaatatcagcaaagacgctaaaccaacactatacaaagcaattcccaggaccgaaattttccattttacagaccaccaaccagtaattctttcaatagagcttccccatattgaaccaccaaacatcacaagaggggtctcatcttctccatctcccacctcgtctacgagctctctttcacttagttttggccgaatggtagattatataataggctactccgggtggctctatttcaaacactcaagaatgggcctactggtgttagtactattttcgatatacctctgggcatcttaagtcttaaatatttcacctgcgatcttactgcgggccattatcatatttacatagtcttctgcccagaaaaattatagatcatagaattgaagaacattatataacgtttttctatgaagtaagatgatgatgatgagaacttggaaaagtgagaactaaagtcactggaaacaccagatttagtcccttgtatgaaggtaacgagtcggactttattaagaaaaggttctggcatcgcacaaaatatggcaacaccaatactaaatgaaatggatgcggctaagaagagacctgttaattacaagcttttgcaagaagccaagaagagcaaaatcagtgcgaaaggcatcggaaagatgcgcgacaagcaagggttccagttaaaaattcaagatgtcaacggctcaagaaataaacaaacggaccctgactatgatgttaagatcgaaggggcactgcgcaagattgtaccatattttttcacttacaaaacgttttgcaaggagagatggagagacagaaagttaattgacatcttcattgatgaatttagagaccgctctcctgaatattatagaaagacaattgcagcgggtaaagtgtacctcaatgactctgtggcagaccttgattcagtggtacgtaacggtgatttaattacgcatgagattcatagacatgagccttcggtgacttcaagacttataaaaacggtgtttgaagatgatgatctgttagtaatagataaacctagcggaataccggtacatccaactggtagatatcgattcaatactgtgactaaaattttggagaaagaacgaggctatactgtccacccatgtaacaggttggatagattgacaagcggattgatgtttttggcaaaaaatccaagaggcgcagatagaatggcagatcaaatgaaagctagagaagtcagtaaagaatatgtggcaagggtggtaggagagtttcctgtcgggttaatagttgtcgataaaccgttgagaaccgtcgatccaaaagtcggtctcaatgtcacttgtaaaattacggatgaaggtgccaaggaagctcgaactagctttgaaaggataagtttcgatggcaagactagtattgttaggtgcaagccattcactggtagaactcatcaaattagagttcatctacaacatctaggacatcccattgctaacgatcctatatactcaaatcctcacatttggggaccatccttgggcaaagattacgaaggagatttctcagatattatagggagcttagatcttgtcggcaagactgagtccgccgagagttggatgcatcctgattcatttggtgaagtcttactcggtcagcaatgtgaaatttgtgacacagagctatattcagatcctggtccaaatgatcttgatttgtggcttcatgcttatcggtacgaatccaccgagcttgattctgatggaaaaaaattatggagttacagaacggacttccctgactgggcgattgagccgcacagaaaatttatggagttggcgatagatgaggcaagaaattgtggtgaaactcaaactgcctttaatgtaggcgcactccttgtcaacggaactgatatactttccaccggttattcgagagaattaccaggaaatactcatgctgagcaatgtgcattagataaatacttcacaaaatcagaaggtgcgaaacttccagatggaaccatcatttacacaacaatggaaccttgttctctaaggctcagtggtaacttgccatgcgtagaccgaataatccaaacaactggcgctataaagactgtcttcgtgggtgttatggaaccggacatttttgtcaagaataataccagctatcacaagttggcacaatatggaatcgactatattctcattcctggttatgaggaagagtgcttaaaggttgcatgtaaaggtcacgacaaaacccagaactaagcttatcaaaaatcactggtgattttgttttgtaggaaactatatttgttaacatgcaattccaagataaacccgtcacaaagtttgtgaattgtatagtgaagatatatatcgcacacaaatgtcggcaaaacagtctaaccactttgaaatccaaccctgtttatatcaatccgttcatacatagacattttgtaattgaaggtatttagcaaaatccaagatgttagaaaacggttgaaacagcaaaaacactaatagcttctaaagcgattatacaggacgtttgtaaatgatccaatttgaatgtggtattacagagtaacagccaatactattattattattatgcacattattattggtgcttgtctgtgctagtttccttgtcacaattctctgaagtagttaccctgaccataccaatcatttgaaaagctctatgtgaaccttctcttacagaggagcatagaaaagaacttctgatgaaccgatgacctatatcaagatatctaaatctcttactcagcacctcaagaactgccaaaggatttccgaaatgatagacggtcgtattatctccaacgacgaaaatagaattgctgacctctatacatattcacaaatcatcaagttggagcattctattactgatttagtaaagcaactaaagacagttattgaactctcaccaaatatcaaacagtatcaccaggcactagaccagttacctacaatgtctagcgatttgatcccatcttttgatagataccagcttaagttggccgctgaattgacttcattgtatcaactgggtaaactagagctattcaataatattattcattacagtgataagttcaaaagtggaagctccacaccgatattacctgaactacaaaatgaaaaccttgatttactctcagccaatgttaccaaatcattacatataaattctcacgaaaattcaaaagctaccgatgaggaagaagaggaagacgatgatgaagatggatatgaggttatagataatgcagtgactgatctaaaaaaaggtaaagaatggcctccgaaactgccgaaaatcaaaaaccctgtgatcagggctcgtgtctttattcataaatcaatgattaacgataaactgtatttaactgaccaagaaattatcagatcacataatgaaagactggagtttttaggtgattccatattgaatacaacaatgaccactatcatttataacaagtttccacattttgatgaagggcaactctctcaactcagaatgagattgatcaacaacgagctgttaaaagaatggtcttttctatacaagtttccagatgaattgaagactcacaatgtaaaacctgatgacaacaaagatggaaaacaaaagctatacgctgatgtttttgaagcttacattggtggcttagtagaagataatggtaagaaaaaccttccaaaaataaggaaatggcttgcgaaattggcagaacctgttatatcaaagggactaaattctgacataacactagaaaatacgacagaagttgatgtaaacgccaagaaaaccctttactctttgatcggatatgcagcgctaaatctccattactaccctgtccacaaaccaacctctactgacccaaatgccatagtggaatgcaggattactggcggtaaagtattgggcagaggtgtcggaaagaacataaagatagcaggaatgcgtgctgcagaggacgtcttaaataataaggagctaatagagaaatacgtgagcctgcgagcttccctcccaaaatctgaatctgtgattaaggcaaacaatgataataccaagaagcggaaacacgaaggtcacagtaatgatcgcggcaaattaaaactactagcagatggatcttttgcattcaaatagttttttgttgtattttttcttaacgagtacgataaatgcatacaaattctaggcttaaactatctaatctataaactgcttatcagtatgtattctttttgagggtggtgaagacaccacgttagcgttaaggttgtgactatcatttggttggtcgtcagcagaagtaacggttttacgttttcttttgtgttctaccccttcatgttcacgttgcacaagtgttaatagagtggctattctcttagaaatatccaaaggtgtccttgttttaataaaccaagaaaatatgaacaatggacttttcagtatttcctgcttgactctttcatatagattactggcaaacaaacccaagttaccgacagtaacgagtaaaaatatatcttctaatgaattgtaagttcttctggtattgttgggaggatataatattttcaattctactaagggatactgatattgctgaagcttctgcttcaaaattgtttcctgtatctttagcttttcagtcttcttttcaccagcttcgatgtttgcgacatacttctcccatccttggacttccttgtagcgtttccaaaacgtttcagagtacctctgaacttcctctggcgttttcgtatgaattgctttggatattgaaacataattgtctctaccaaattttatgcatgcactgatgaaggctaaaaattcacgtttattccaattatagaaagattcttccaggaatctttgcttttgttccaaattttcatcagtgaattcttcagcagcgtcaatttttgcttgctcttcagcaatcttagcgtcaatatcatcttcttgtttttgtgcattgttagtatcatctgattctccgtccgatctggaatcctcttcgtcatcatcgtcaccctcactttcatctgcgtgttctttaacatcatatgcggtgattttgtatccgacacttttcttataccaaagttgttctagctcctgtagccggacaaattctggatgtgcaaactgataataagtcatacgaataactttaggttgttttggtaatttcagagctggggtgttgcttcctgaaggtttgctctttccattacctataacttctctataataatcatccactgaatacagaggctgttctcgtctacgctctcttttaggcggattgatccaatcaacagtatgatcatctggcttcttcttctcaaaatttgttccattccattcgtaagcggattgatcagccataccattgaacttttgtaggtcatcgagaccaagagattcatattttgcattaagttccaatgtctttctctcaccctttttcaaaatttcatcaatgtcttcatcaacagttatattaccagagccatgctgaagcatatctcttgctccaaattgtatcatatcaattaggtcatctttgttgttcgtcagcgccgaagtcttctttcctgtaccctgctgaattaccaactggtctaatctaagtttttgagcagccctctctatcactttctcttcaattgcattttcggtgacgaatctatacacaaacacctgttttttttgaccaatcctatgagcacgatccatggcttgtaaatcggcctgtggattccaatcggaatcatagagtacaacagtatcggctgtcactaagttaatacccaatcctccagcacgagtagtaagtaaaaaaataaatttttccgaatttggtttattatactcatcaatagcttcaactctttcatcatgcgaagttgagccatcaattctgcagtattcatatcccctgaaataacagtaatcttctaaaatatctagcaaccgtgacatttgtgaaaatataaggactctcgagccttgttcctttttcttttttagcaatttatcaagtacaatcatttttcccgaattgaagactaaatgttcatctgtagtataaggagggccaggttctgctccttcgaaaaggtatggatgattgcaacactttctcaactgcataacaatatttaataatcttgttttaccttctcgcttaccgacggctccatttacggcatcgatgtctttctccaatagtgatttgtaccattctatttgcatgtccgtcatccctacgtatagattaatctctttcttcggaagtaatgatttttcgacctcagatttcactcttctaagtaaaaaaggttgtaaaaccgaatgaagttgctgaacaacaacctcttgatcttcttcctttccgttttgttggaaccattcatcaaatacttctgagtcaccaaagacatcaggtagtaagaaattcaaaagagcccaaagttcatgcaaattgttctgtagaggtgtaccagtgattaagagacgatttttggagtaaaacagtcttatcacctgtgacaaggcgctctgttcattcttaattcgatgagcttcgtcgattagaatatattcccatgcaaatcttttaagtgttaacttctctttcaataccatctcataagaggtaattagcacgtcaaagttacatgttaaaatcttagtttcaatgagttcttttctgaaatccttgtcaccttgaagaatgactgttttgacttcaggagtccatttggcaaactctctttgccagttatctagtgtggatttaggtacaatcacaatatatggcccctcgatacctttaatataccgaagataacctaggaacgatattgattgcaacgttttaccaagtcccatttcatcagccaaaatcccagaaagcttgctttcatgtagagaaatcaaccaattcagaccgtaaacttgataatctcttaatttcccttcctttatgaaactcggtgattgtgtcaaaattgttgtatcctcttctaactcaacttcctcatcctccatcaattcagcatcttcttcttgttctgtctttctatagtgccttggagccctagcgagatgaccggctggctctttcaacgttccagcaactttgttttcagcatctatggtcttcagtaatttttgcatgtttttatcatatttggctctgatcccaataaagtgtctgaaaagatcagtaatttgcaaaaggtgcttgaagcgaatataagtgtcttctttattcctttgtttagctattttcggatcaacatcaagtaagaacttagatcttctttcggaccagtacttctcatcatgttgattattgctaacaggattctccatttttgtagcagatttctatgagtatttttagataaaggtggttagtatcttatgcagaggtccgcccaagtgtgaagttgttatgtgcttctagtgattactgtcatcctaatacgttgataaactcaacggggagaagcaccgaagttcatgacagatattatcagtaaccattgaagtacagttgaacataaagacatttagcatacctcttcctcaaccattgtaggcaatgttgatcgatgatgataggatggcaacagagaattcgatatccataggtttcttagtggagtgtggatagtcacaactcattattttttggaaatttacattttttcaaatcgctaggacaacaaaccgcgtggaaaatgatgataatacatgatctcagaacggacatacctcagagtagtctcattgactttaaagaacaaagcgtggcagaatgtgattagccttgcatctaccattagtacaaagcgcagaataagtagaacatgaccatttaatatttacacgattaagttgatatagatatacataacttgtaagatcacatatgtgatcaagaacgatatcaagcgcatactgattaagtggttcagctgccttttttagtaccgattgttgctctgaattataccacttagcgagatttggtatgctctataacatgtatttaggattgtctatttggatttgtgcaacttcttcttcgattgttactcgtattggatgtctgatcatgcttttcaggttgatttgtcgatattttggatgtgttatttccacgcatagatttatccgctgatttacttttgcgtttaccattagattgtatcgaagaagattttttaagggaaccaggcttcgaagatgggattccggtctccattcccattagcatctccgacgccgcttgttgggcttgtatcctttgtgattcttcattccaccacttcaaaaattttgcttcctccaaagcttcctgaatagattttgttggtgtgggtgtcgtttccttagcgacccaggataagttactcttggtagaggcatataatggcatagtttgcttcgtaccgtcacccgaaattgcgaccatacctgttggctttttcccgtttttcacagcttcatgcaacgttggaaatttggtcgaagctggctttacacctgaaagattttttacctccgaagatacagtcacttttgttgattgtttgtttgttaacggggacttcctcatatgttggccccaaactttagtcttgtcttcatttggcttctcctggaatttggcttcctcagccatccgtttaattttctctttttgagtttccttctttatttttatcttgacggtactatttgacttgttagtcgtttcaccaagagcagggaatgaatgttctgaactatttttgcgaaccagtaacctgttcccgtccatgttggtatgaatttcatgcgccgctttgtcatctatcgaagcagctcttgttatgctggatggtcttcgtttcttcttcttagaaacctcaacaaaagtagactgatcatcgtcatcatcaattgcggaatctgtcatgttatatgacttattccaagcaatcgaattctgggctacagcgcttggttttctaatatttaccagattctcattgatggatgagcttcgtgtagttttactgatgctgggtttccttacatctaaaccactcttttgtctatgctttttataaataactgagtctaccaaaatctccaatggattttcctccgagatgaaatgagaattgaaagcgacaatattcttttccagttgacgaatgtaatctgacgctttcggtccataataccaactttcctgtgagcacatgcctaattctgttctaaatttttgctcaatggatttccacatttctgatgtgatgttttgcatgatatgctctacggtgtcagagctaaataagacagaaggattcctgaagatatactcctgacagttggcggctaaatccggtaaattaaggtcgctagctgcaatccagaaagcaataacattgtttgaattaactgatgatatcaactggctttctatatgttggactaacgtcaaaagcataaatttatctgatatttcaagcatgtgcaataacctatcgtgatacctttgatgtcccatattgaatgcaattttatcaagtacctgagtagatttcttttgacaggatatattatagatgcaatcaagaatgcttctgcagatatcataagagagatctgtccagtccactttatgatcgctgaaattagctgaccaggtttgagagaaaagtcttctgaaatacatagaatgggcctgtaaaataaatgagtaggccagaacactcttaccgtcctctaaaagaagggtgacattcggtgagactggaaaatcaggttgtattgaaattttgatgtttctttctaaagtacttggttgtgtaaaaaaactcggtaagtaatagacatcaataaagttctgaagagttgcacaattgagagcttgcatattttcgtcggagactgaataataacaagaaatgcagcttttgaaataaatgccgaagtcctcaggtccgaagatctcgagcgtccacacataaccattttctgtacttagattcatatcaatagcttctaatttgttcctccaaacaatttttccattagttattagttccaagtaaagcttttcctgggcggctgcaagtattgccctatggcaagatgtcaaccttttcccattaaatatcacatcaaggtcataattgtcatttaacttaagattagattgttgtttaaaatcaggttcagtaatcattgcagtatgttcggctgttaaaacattgaatgaagcaaacaatggatcgcaagatacctgacaagatgaggcacctgccatactatcttgtaacttggtgaacttacgacctaacaaaggacttgagtaaatatcacttttcgcagttaaaacaataagctgcccagcactgcctatatcgaaagatatacacttatcccaggagtacttcggcctccagaaacattgtggtataggtgactttttgaaatccggaatacaagcaacggtaccgtcatcatagagtaacatcaggtttttaccatgtgagtctttgcatttgatatcaactatttgatgatcatgaaattttcgactgaaaaacttgtcgaaagaatcgtgcagtgaaggtgtcgttttaactgtcaatattctataattcgtaagcgcaaatagtcgatttccaccgcataaaataaaagtaacgaggtctgtacagacaagaacagtcggctcgtttatatcagctggtaaaaacgaggtaactggttgtggcgaaatttgtcctttttgatcgagataaggggtctcttttttgaatttactagtagatccaaattgaccaacgtctaatccccaagatttgattgaaccagattttgatagcacgcatgtgtgtatattcgaacatgcgattagatcatcttttccgagtccaagctctattgaattgggttgatctgaaaactcggtggttttagggtttaaacccaattgaccatatttattggacccccataaaagtatatttccattggttgttttggcaattatatgatgattggagcacttgatatcttgtaatttcttgtcagagaattttacatacctgaagagatctctttttccaaacaaatttaatttcgtagaacggccagtgatgtatgctgaatttgttccatccttgtctaccatcaataacagagagtagtatttggtcatacagcatgatttaaatcttagatcattatcacacatcttccaagaatcaatttcataccatgaggttaatctatcattattatcaccggtacctaactgcatgttgacattggaaccaaaattgaaacatctggagtaggattttccactcttgacatccttattgagtagtttcctcttataccctgccttattcataaccatcgattgcaatagcagtaaaggtgacataccagatttatcagttatttgccaggatttaccagcatcatgcggatcctgtaggcttcttgcgtacaacttgtaacatttctctaattggaagcttagcatacacaaatgaaacgcagtatatccgctctcccaatcttgatccatgaggttgatccttttcaactgtgaatcattagcagctggccacatggacaagtgatacgaaagagttcttcccatacaatctctcacatcggtcataatatagttgcctttattgacgtcctcccaacggtctgatatagtggatacttaggatgttcttccaaaatttaacgttgtttataagatacctgatgaactgaagctactttctaacccagcactgtgatgtgccccatacacgttcctcattcatttactatatatacttcgcattaatcatattgtaagttgcaagataaagttgtccgggtaacattttcgaggaacacgatcaatactcaataagtgcataataacccataatatctcgtaacgtcgtgaggattgcgcgaacttggataaataaagactgagagttatcccaagaggtgagttattatgtatcatgtaaaagagtagttatcaaaaagtatagagagtagcgcttgaccgctaagatagaaagtgtgatttaagaaagtgaaaagttgaataaattagaatactctctcagtcgccaatgatgaagtatttaaggttagcttgacttttggacccttcaaggctctatactgggacatgttatcgaagtatctgtcgaaaagtacagcagaatctctcgggcctcccttagcttccggatggaattgagtcgagaagattggccttgagacatgaatcataccttcattggacttatcgttcaagttttggaagaaaggtttgaacccagattctggaagagtgtcaacatcaacagcatatccatgattttgtgaagtaatgtgacattgaccagtggtcaagtccaatgctgggatattgtgagctctattaccataacctagtttaattgttttaccaccagatgccaaagctaacaattgatgacctagacaaataccgaagattggcaaatcttgcaaggtattggtctctaacaatttcttcaattctggaacagtagattccatacattgaacaggatcacctggaccattagaaatgaagataccgtcgaactggtttgctactgatgtgattgggtagtcatatgggaaaacagtaacgttagcacctctttccactaaacatctaataatgttttccttgacaccacaatcaatcaaagcaacgttgaatggagttttcactgaggacaatgctttcacaaagaatggtttctttgtcgagacaatcttaaccaagtcagtttctggtttgattggcttagggataaaagaaccttgcacagtaattgtagaaggtgatgacccttgttctctcaaaatttgaacaacggcacgagtatcaatgccaccaatggcggtgacgttttccctttggcaccatgttgccaagctttcaacagcagtccagtgagagtatctccaagcatactcagcaacaacaataccgcggacgtgaatgtgaggagattccaagtacttcaataggttaaagtcatcacgttcttctccactaggcacaccgtagttaccgattaatggttgcgtaaagacgaggatttgacccttataggatggatctgtcatcgactccggatagccaactaaagaagtggtgaaaacggcttcaccactgcatgagacaggagcaccgaaggaatagccttggaactcgacaaacccagattccgaatctggatttgaattattataaatggcaaatttagctttaggagcagtacttttgaaattaggcattgttatttttccagatatggtcttgaatgtagtcttggcaagtgtatgaagagaagcagagtctaaacatacaacttaaaaaagagtgggataaaggttttttgagatttaagctctggctcaaacaatcagagcaataaaatttctttaacgaagaatgggaattgttagttgagaagagatataaattcaaaattctctaataatatgatagcagatttcgattgatgatcaaaatttttagcaatcgtaaagtcttgactatcaagttttcagtccagtctatgtgggtttcgtttgcaacagctgagtacggtttgtggaagaagtttataatgttctctggaattgcactgaactgtcagaaaagagataaaaaaacttgctatggttcttgtatttatatcactatggctcttatattttatcataaaagaaaagctttatttaattctcatcgcatttcttgagatagtgatgcaatttgaatgtcatctcgaatttgcatctcggtgactaaatagaaaagaaacgatttccctgtgaaaaaaaaaaaaattagcgagtcctcccatgtttgtatgtaatatatgggtttggggtttggtggagggtaactgagaatttggtgtttctgttgttcaaccaaatgcacgtgacttgtttagattatcatacacacttccgttaagttcgtagaggcagagagaaacaacataaataggattagttatcatcattacgttattattgatattagatatactgtagctattacttaaaggattaaagtcattaaaaattgaattttattgttcgaatttgtggtttcatattctacgtccaggcacggcagcaaagattgctgtcagtattgccgtcataatcaagaccaatagtaggcaccagagggctcgtcttatcattattgagttcacaaacggatgttttactttgcataatctagatctgcctccaaaaatagttaaccaccagggcacctcgttcgaagagtgaagtgaatttgaacgatgattattcatcgatcttagttccaggtcatcaagtttacgttttgaaactagtgtttgagtaactccactgaatgcgtagatgatatctactaagtagataccacatattatgtagtaagatcccaaaaaaaatggaacaatgcataccacccttattcccttcgagtagttcataaatattagtgtataaccaatccaaagccctaccagccaccatgcgagtccaatagtaagtctggaggcagtagaccattggctgaagggagagtttgaacgagagttgtatgatttatttttcttaggtctttgcaatacaatctcatcatgtaaattgtgcaatgcaacgcatcctaagaatcttgggaaacagtccacttctaagaattgataaacaatttctttaattggttcgaacacttcagggtcatgtctcttctcttccataataagccttatcgtatcgtttcttaaatatgctggaatttcaaataaaaatctatcactttgttcttgagagagtaagtaggtggatacaatatcttgtgcacttgatattagctgctttgtggtgagctttggtttatgatccttcgtaacattactcttgactaacccatctacgaaatcgctgaaatcaatttgatcgttgttcacttgtttccagtcctgcaatagctgagataaacgaggagagtccgtttcacctttcaaaaactgactcacacgctgtgagtcattataatccaagtaaccatcattcattagtgcctctagaagcattgccgatgatactgattctctcttgtcatctccattaccttcttgcaaaacagtaggagtttcaagcttgttaacatcaagaacagactctcgtatacccttcacataatctttgcacaatcgcagatatgccatcacatcagtccaaaaatcgagatacactatggcatgggggtattgggacaggtaagtatagaaggaccataaatccaaaggcgcagcggtttgttggtttaatacttcatatagagtgggtaagcgggctcgctgggaatttggcaatttttccatgactattgctcagcggtttgctaacactggaatggcttcaaagtgctgttaagatgtccggtatttcaataggagcagtttctttgaatatactgtgacaacaacaactacggactggttgaaagagataaattatatttctcagataacgtgtaaggtgccacttgcctgttaattgaagtatttcgacgaccgttagctacacaaactgaccgttagcaattgagtaggaattggtgagttgtcaatatgtctttctcatctctgtattttagaatgagttgagtttcagtttcatgcttttttttttttgtaaggccagatcaagaatttttctcgattaggaaaaaccagcatgtaatttgcatcaacaatgggtctaatagtttggaaaggatgggaaatcaattccaagtattcgatactcgagaattatatgggcaactttcttactaaaacaacttaaaaatatccataattatttactggcttccatctttcatcattagaagggccttatacgtgactttcgaaacttcattataaaatcgataagtaatggacatagaatcgttgattgacttacatataacatcagtagtagattacacggtttaacttcgtaaacctggggaaattttatgcattactatttaacaaatgctgaacaagcttcatgatttcttcgtgaaagaaagtatacatggatgatgaagctgacgtaataaatacgtagctcagtattctgtcacatcgaacttgcatgctaaaactcactttattaatatgttacaattataagaccatccatactgtccccaatacaagaacaccaagcacaattgtagtaataatacctgcaccggctttgtctcctgctgtgatgttgatgttcttctgtaagacatttgtggtactgacgtttagaccggcactagcatcaccactggaagacccaccagtgctttcagttaatggcgctggtagatcgtgaacaagcaattggttaatgatttccaaagcgcacgcctgttcaccaagaccatactgcccatcccaatcaccagtaaaccaatttaatccacaggtatggccatcagtaccaccgctacatgatttggctgctgctgctgcactagtgtctatgagaggggttattgtatccgttgtgaacggagccaaaactgaagtataacctaacattcttgagaaaattgctttaaagacacgctgatctgtattacatttgtttgaagcttggcatgtactttcatacattatgtcatcttcgaaaaagaatgaagtggccccacctaaaatttgttcggtacgtgtctgccagacatcagacccatttgttgcattgtacatatacgcgcatccgccaagaacaacaccatggttatagctccattcgtatttcacaatggaagtacagttatcgtcgatagtcgcaccatcgaaaacattggcctcttccttcattactacgaaatcaatatcgacaagccaatcgaagaccttttctgctacctccaaataagtagtgttacccgtatatcttccgagtcgtgctgccaattggaagagacaaccattggaaattgtgttcttataattgtatcccgagttccaggtaaagatttgccatcttaagccaccgttacaatggtctgaatcccaacgtgagtacatttgattgaaaacagcttgtaccatggccaaccagccaggtgtgccgtcttccttcggatttgtgaaatttctttccacggcagtcattactgtcaaagcccaaacaccttgatcatcattaccttccaccatagtttgattacttggcatgtaatcataatcggacccagtttgtgccatcaaagcatcgtaaagcatatcttcatacgatgtattttgacatagataccaattttcaatcatacctccgaagacaagtccggcttcccaccaatagtatggcgatacaaacataccgacagtcccaccatatacgtcaccttcatagtaatcactaataccttgttgaatcaaagcagttgctgtacatatcgacgacttggaactagtgtccaaatcaatcgcaaggacggatactaccgttaaaaacaagctgtacaacggactaatcttcattatgatttccctagcgatggaggtaaatataataataaggacttagaccccggaagtgaacttagcagcctgatttggtgtaataaatagcagaatatccgaggataggtgaaagaacgctgaataattgttttcctcgtcagataccaattgcttactattggtatcttctgtctaaatttcaaatgccactgtttattaattattgaatatctcacaacagaagagggcttcagttatcattaagtataaactctgtgggttggtttcctgctatttctgtttttagaaatgtcaaatcaatgccattattttgcacgtgatatggaaatatttcatgatgagccccattggtatttaactagggtaaccggaaaatcatgtagggcagaatcagatgcgttcctattgcaggaatatcaggtttcaagaccataccgatttatcttgcattgcctttgttgaaaagtattgacaggcatcgcagaaatttacctgtaaattacgatgtattatacaaaattcctagctagcatttatcagctgacaactctagagctgtattttctgaggtggtataggtgaccgagatttaaagatgtaatagtgatgatattatgtatgttaattgttatatgactgcaagcccaaacaccacagatccaccatattttttaccatatgttggcataagtttcaaatgggctcgagtttatccaacatggacctaacaataaagccatgtgccatagacacaggcagcatgtacaccctgccaaaaaaattgtaggtaaccacactggtggctattctgaattcatttctcaggtcatcgtggttcttgatttgcaatgctaccaatacacttaaatgcttgtcagtagacttcaaaaatagttcatcatccgacactttgacaacgtcgaagaaatctgctttatcgcctacttttagcggcttcgcagaaccctcaaaacccttaatcgactgtatcccacccaaccacttactaagaaaatctcttgttttgaatgccgtatccaaccacaaaggtacgttgcttgtcatcaattgataagcttgagtggttgtcatctgcttatcaataagcttctgatcttgatggatgtaatttaaagtgttgagcggagcaaccagaggtattaggtctttttctgtgtttgttgaattcgacatacctgtatgagagtcgcagaactgctttcactaatcagtggattttgtttgatgaagtaaaatggcctacagtatttgcttatcattccaagaaatgttcacaaagtgggggagatctcagacattcgaactactttcttattgaatacgaccaaatatattttcttataatactttttgaccatagatgttcaatatgaactcgacggtggcttacaaatagactgatttcgatcaactcttattggtgaagactgcttggtaagcaacttactaatatatactttctgttctatctacagtaaagagggcactgtttggatccagtttgggaaatagctgatgcatttaaaaggttatcaaatgtatgtgtgcgttgtcggatcttaagtattgcattcgactagaaaaaattaagccaccttaatagcactagtgacaggtgagaaacgaccagcaggtttttctggcagtactgtttccttttggtacatgctgaaaggtgtatggatatacaattccagcacgaacgttaccggatattttcgaattcttgcccaatgctgccatgattggttcacacgctaccagagatcgacactggaaagtgatacaatcaaaaacacattttggttatttctcaatgcacttgaaaggcaataatgattcggtacagctctaggaccttagtggctaacttgctactaagaaggtatttcaacggtgtatactaatttattggacagaaatcaaaaatatgtgacattaatatacagacatgtaggatagaattcactgtatggagtttacacagtcttataatacataaatgagagatcacttttcagtaatgttaaaatcattcatcgtagtaattgttgctgtattcctggaaaaatcgtagaatattgtcatggaataggccagacacggattctgggaatctggaattgacttcattctctactctggtgatacccaaattctcaacaacttttgccatggcatctaaaagtaacattgagaattctgcataccaacggtggctccaacaacaaagcttgacgcaaatagttatgatttctagatcagtatcctcagaagggtttgattcacgttccattagtagaatctgtagtaactttcttgaggactgagagctaaatcttttctgtaggccattttggaacgcagcctttgcgctttggaattgtctcaaacggaagcaacataatccaattaattcccactctaaggttgtttctggcttcaattcattggattgccattgagaatggacccttaaatcatcatataacaacatgaagagattatcaaaccacctttcacataaacgcttccctcttatgtcccgagttacttctttttctgattcggtttcggaagtggcgtccagatgatcatattcttcttccattaaaaatagttcagctcttaattgtaatagtttctcccatcctaaacttttcactatttcacatagaagttcatagatccattgaaatgtgtttttcaaattggcagactttaagttgtacaagacggggttaacaatcttatgttcttccattactagaagtgaattgagattagtgacttcgtctaatacgacatctaaagggagtgggaggtgtaattcaacagtagcattgtttccatcagtattcaagattcttcgatactgatatttttgtgctaaggatgcgaggttcattggtaatgaatttaacgataacaaggcgtttttgttatcacctaacgcaatgtaagacttaaccaaataaaaccaaggcatgaaagcattcggggtcaaatcaacaccacgttgacttgcttctagtgctaatagtggatcgtcgtgtttcagtaggtattttgcttgtaggagcaacaattcacattgataggttggatccttaatttcctgtaatgtatcatggatcaattttattccatctaactctttatcattagtcaaataaattcttgcaattataatgttaactagtggaccaaaagcttccttcaattcatgcaacattggtaggcataaatcaatggattttgtgaagcgaacaatttcacataaagtttccaccagatagttattggttaaagtggaaggcatattaccgtatatacacgggcaaccaacctcaatgccacgagggaagaatagcgggaataatttgaagaacatttcatctacagaatccaattgaccagtcatcaaggggttgtaaattctagtctccacaacattgataacttctccatcatctctattctctaccatacacattatgtctctcattttcccactgatgaaggcttcagcccacgccatatcagtatcttcatctgagtcgaattgtagcttattacgatttttgtcaacaaaatctatttcaaaggtacctggcagatacatcttaatagtcatatcacattgtttgaagatattccaagtagtgaacgagatccattcgagagtgaatttaacattcttgccaaaccataactgtggtttttcctgaatgcattccatcaattgtttcaaccacactgcaatactagctggatctgaagtgtccagtccagccacataaaaaaaggagccgacggttttcttttgagagtcgtgcttcgcaatggtgaccaaatcctggggacctaagctagctacaaactccggatcagataattttgcaatacgtccattgaaagcttgaccgggtgtctcttcaacaactctgtaattatcaacttgcacttcattcatatttttctaagatcattggactcagtaggaagggtgtgacttcttaacaaggtgcctttttttgtcttggacaagttgctctacacatttcccaccaaagtagtcaatgtcctcagtttttgaatgaaggtatagcgttgttatgttagtaattgtgccatttaattcgaaacacgtcctagtgtgacctaaaaccccagaaaacgagagaatacatactccggaattgagtcctgtgatagagccattgttgatgattgatgttccttgatctgttactgctttatactatgtggtttatgcaaagcatgggacgccactggcaagtttgttcatcttgcgaaggtgtgcagtttattcatagaaatcgttttcatttcttcgaaagatgatattatagtaatgataataataatacgtaagtgtaaaagagaaaaaaagaccaggtaaccaaatatatataaaaagggaacagagcaagcgcaacacatacaattctgtatatgtttgtatatagtatgcactcttactcgtcaatcgaccattctttggcagtgagacagtacttttctggaggcaaacgcacaccccaagatgacacaacgttgggcaacggtttcttgtttctctctgccgcaagctgtaacatgagttcctttggagcagtaggcttgaattggtactgtgtgcgagctccgatcgctaaccgtatatcttctatcgaaacatccgaagcagaccctcctacgtactctctataagcaatagcatctttcaaaacacctttggtatatctatgagcgaaatccatcaactgtaacggcactttgtcttcgtattgcaacacagactgagaagcaagaagcaagtgaagtaatctcacatccctaggagtatctaacgtatccttatcaccgtcttccattgtcgagttaggtatctgccgaccctgtaaatacaaagaaattcccctacttattgagatcgatattgttcttgctatgcttccattgaaagttcgcttgtcatttaactttttcgtttctgttcgatgttgaaaaagtgaaaaaagtgaaaaaaatcccgaaatttggtataaaaggcggaatgagaaattaggatggattttagacccaaatgttgcgttgttgtaaggtacaagataagaagagtaacaacgtatacaaacgctactactgtaccacgtatttgtagtatacttttgaatccggtgaaaaagaaaacagttcaaaaaagagaaatgtctgaatgggaacccagcacagtgattggccgtaaggttagaattggcggtggtggtcctcgccagcaggtggcaagaacacagggtcaaatcaacgaggctagaaggtctggtatggttctgtccgtcgataagaagtacggtactactaattctaagtcctccccagaaggccaacggttgaccaaagtggaccgtgaaaccgatattgtgaaaccaaaaaagatcgacgtcagcgttggtaaagctattcagaagggtagacaagacaagaacctaacacagaaggacttggctactaagattaacgagaagccaactatcgtcaacgattatgaatccggtaggggtattcctaaccagcagattttgggtaagatggagcgtgccttgggtatcaagttgcgtggtaagaacattggtgagcctttgggcggtccaaagaaatagatttttctttcattaaaagattttaacggtagttgaaggaaaaagagcaggatatcttgtgtgtcctcttttatttatcctgtcgtatccgttccaatttcgtttgaaatgaatttttaatggataatgatcattgctttctctcataattaatttacgtagttactttcattattgggcctaatatctcagacccttcgaatatgtatttcgtgtgtacatgctactaataaacgtgtaatgccacacaaccagagctctatcactggtagtgaatgtcgaattacaaatatgttctatcacgtgatgcaactttattcctcgaagaatcgaagaaagaaaaaaatttgattaactagtcccataaactgacattgatgacggatacagcctaaatttagtatcaaatactcgtgaatctgtctcactcggtgttcctgatcgctgacatttctcaatagaaaacaatgtcgtttagcaaggctggtttacagcaaaaatggacttctgaagaagatatcaaaagtgttctcgatgagttgaaatcgatggacaaagttacctctttggatctctcaggaaacactatcggtgtggaagcttcaagagctctagctaaaactatcaaagaaaatgcttcgattcgtgataacgttgaagaagtgaattttgcggacatgtacacctctagattggtcgatgaggttgtcgaatcgctacaactgttgttgccagctttgcaagcgtgtccaaaattgagcaaagtggatttatcagataatgcgttcggattgcgtactattgactcattagaaaagttcatcagagaaactgtgcagttgaaacatctgattttagctaacaacggtatgggtccatttgcgggagaaagaatcggtaaggccttatatcaacttgccaaaaataaggaaaaggctggtgaatcgctgttggaaacatttgtctgcggcagaaatagattagaaaatggatccacgcgttggctatctcaaggtttaagagctcatggtgatgatttacatgctgttcgtttataccaaaacggaattagaccacagggttgtattaatttgatcaaacatgggctatctcacaacaaaaacttgcatgtattagatttgcaagataatacattcactgctgttgcatcagagacacttgcaaaatatttaactaattgggctcaactaaaggaattgaacttgaacgattgtttgttgaagggtcctggttctcatgcagtcttgaaagttttgaaggagaataaattcgacgatttagaaactttgaagttgcaatacaatgaattaactcaacagagtttagaacatttattaattcctgctttacaagatggtaacttaccatcattgaaattgttggaattgaatggtaatagattagaagaggattccgatcctttatcgatattacctactttgttcgacggcgaattagatgaattggatgatttggaagaaattgactccgaagaagaggaagaaagtgaagacgaagacgccgaggaagaagacgtgtgggaaccaacacaatttgttaaggatgaaaccgtcgatgaattggcatccgaattggcaaaaactcatttagaataaataaactaatacttattgatccttgcataaatgacgtcctacattccaatttcctgttgtaatgtaataaatagctaaaacctgaaacagaactcattatatttctcgcaataccatcaacccggaatgtacacatacaatattgtatcattttttagactatctccacgttcaattcaaaggtatctatcaatttatccttagcacaccactgggtttctagccaactttctagttgtttgggtttctttttagtgagtttatcaacatcatggtacgatgcgtggatgcatagtatcattggtgattccaacgaccatatgtcccatagagctggaattgtttgctccaacttatactcacccattgagttcaacgtgatcttgtaataaaccaaagttaaatctagtaacttcattgagtcacgtaatatcggttctgtcggaagaataaggtactccaacatgcgacaccattttctgtcattgctgtttgaaaaagctttgatcagatttacgaaagtaccaaatctggggtatagaacgttatgcaaaacaggtaatcctttgtatttcaatttcattaactttctttcaatcaatttaacttctggtgtgaagatattcacctcgggaaatattaccaaattctcaggcccataaaacttcttaatctttgataccgaaacgttgtcattctcatcatgcctgaatattgtccaaaaatgcttaaaactgggatacttcattaaacgagtccaacctgcgaaaattacattttcagctccgaactgggattgaatcaaagtataatcgataattgatctatggttgcttagtattagttggttcttacattttgtgttgattgtttccccctcgtaaataatttggatatcttctcttagcacactccatataatgaattcattaatccatatattaaccatggtttgaatcttctcagttttcataatacccctgtaataatactttgatgaaatgattctggaccattgattcatataccatatccaccctgctagcactgactgaagtatgaaaagtataaacaaaaaccatgaataggccacacattttataagatgcttgtcttgtatcgaaaaccatggtcccgtgacatttgtttgcaacgtactcagtacagacatggtttactagttcttcatcctaacagaaaacgattgtaatggatcgttttctagctagttaggaacagtttctgtgtttattccacactgacacagactttttaaccattttgttttgtcgcatgacaaacagtttcaagtgaaaaataggaaaacgtaaacagtacgaccatcgtttagtttacattagaaaaacttgtcaccgatacattgtaattagaatgtaaattttacgattgaattaattcatagagcctctaacagaaaccactaccgctataactgcctttctggttattctgcatcttctgtattcttttcagatctcatcaattttgctccaatctcattatcgatgatgaagtgaaaaatgaaatattttttgactaagctcatctcatcacttcgcatacatcgaaaagtacctgaaaagtaaggatggcagccaagacgacataatgattgccagatcaatgataaacaagccacttccagtcatgttaagaacttctttgcttcatcgtcagttgagaggtatcaggctaccagctgtttttagttccagtaagtttgcgaagtacaagttaatcccaccacctccaggcggagttaccggaaacgtaaacgataacttaccaaagacagaaccgaattggttccatgggtcgtatcactgggattatgaacgtatcactgcagtgtcgttagttcctttgacaatggttcctttgtatggagctatgtcttctgctacctttgcatcaggtttccccttcccagtgattgattctctattggccagtacaatactaatacatgcgtacttaggtataacaagttgcattattgactatatccctaagagaaaattcggattctggcacaaggctgctaaattcgctttggcacttggaagctccttcagtctttacggaatttatgttttagaaacggaaaataacggactaatagatttggtctctactctttgggataaagataagggggattcgagagcatatgtatttggaaggttttagtgtggtactctgtccaagcaatatgtaattcatcggagaattgacctccaagcagattagactctcatttatttattatcattattatttattagtgctacatctagtgttatttattcttaccatagtcttaatttagtctttgagtctgatgattcagctggtccttttcctcgccaaaagttcaaacggggtaaagcaatctaactttgaatagaccattttgggtattttgctgttcgtttttttgcccatgattacatgcgtttaaagttgttgatccaatctcattgtaactgccttttttggcaatcacatagattacagccggtttgacacaatttaatgaaataaaatcctgaatgcaaaagactttgcattcgtctctgctgaagaaaaaccgcctcaagttgaggagattactaaatgtgctttgggtttgaaacttattgaggttttttttttttcattccttcatgaaacttattcatgtcaagagaacatacttcaaaagtgactatataaaggcacctctctgtgatacaaggtgagattgagagactcaatgttgatttgacatccttcaaatttttacgtcaaagtacccttaatgttttgacaataagcattaacttatttaacatgtcagaagagatacccagtttgaacccattgttctacaatgagacatataatccattgcagtccgtcctaacatacagttcaatttacggagatgggactgaaataacatttcaacagctacaaaatcttgtccatgaaaacatcacccaagcaattatttttggaacaaggatcggcgctgctggattagcgttgattataatgtggatggtctctaagaatagaaagacgccgatattcataataaatcagagttctttggttcttacaattgttcaatctgctttatatctatcatatttgttgagcaattttggaggagttccctttgctctaactttgttcccacagatgataggcgaccgtgacaaacatctttacggtgccgtgactctaattcaatgtctattggttgcgtgtattgaggtctcgttagtctttcaggtaagagtcattttcaaagcagatagatataggaagataggaatcattttgactggcgtctccgctagttttggtgctgcaactgtagccatgtggatgattactgcaataaaatctattattgtagtgtatgatagtccattgaacaaagttgacacatattattacaacatagcagttattttacttgcatgttcaataaatttcatcactcttcttctatcagtgaaacttttcctggctttcagagctaggagacatttaggtttgaaacaatttgactcatttcacattctactcatcatgtctactcagacattaataggtccatcggttttgtatattctcgcctacgcgctgaacaataaaggagttaagtcgttgacttctattgctacattgcttgtagttctttccctacctttgacatctatctgggctgctgctgcaaatgatgcaccaagtgccagtactttctatcgccaattcaacccttactctgcacaaaatcgtgatgattcatcatcctactcttatggtaaagcctttagtgacaaatactctttcagtaactcaccacaaacttcggatggttgtagttcaaaggaacttgaactatctacacagttggagatggatttagagtctggcgaatcttttatggatagagcaaaaaggtccgattttgtttcttctccaggatcaacagatgcaacagtgattaaacaattgaaagcttccaacatctatacctcagaaacagatgctgatgaagaggcaagggcattttgggtgaatgcaattcatgaaaacaaagatgacggtttaatgcaatcgaaaaccgtattcaaagaattaagataaacactgtgtctctggtttctagttttttacgttctgttgagctctatcataccaatcatatattttagtaaggtatacatatagcagctcatagtatctgctggttctttaatttcatttaattatactttagaattactctttatcgattagtttcataatattgttaggaagaataagaccccattaaggatattggaaatgtggtagacccagtataaatttcttatgccgtacatgaaagaataaaaggataaatatcctagaattgagacaacgatcagccagttcattctgttcttgattataggaatattgcactgactatttcttaatgttagaagcaatgttggtgctatggctaagaaattatgatgcgatctgaaggccgtctcccacctaatcgcaaaattacgcaagaagacgacaactattggagcattgattggtatcatgaatattgttagcattaagaatgacacgttatagttgtgtatattggaatattttgcgttgttcctgtttgtaaagactgccagcttcatgcagttccacatttgaattaagcttacaaggatgaatgcgaactgatatgggacatagaccatgactcccaaagaaataaaacatactcccagtaattgcctgttattaaaaagtagtttatgatgtgtcatatcgttaagaggatcaggaaatgtgatacgcgtatatcttgtgattgctgaggaaattttaataactgcaaattcgatgacatttatgagtctcaaaataatgaataataatgcgacagagattatgaaaaagactggtccaatccaccacacaaatgtttcacgtagacccagcatatagttattgttcaacatatgagaatcgctacttggtttgctcaaagaaatagggtctaagtaatgcagcaaggtcaatatggccttatgattgattgctatcggtcctactgataaaaagaggaatattaatagactatgattattcaaaacattcatcaaaccagtatcaaagctgatgaatttactatcagggctgtcatagtagtaaaactggtagcataagactaaagcaattatcgatattggaattgatgcaaaagctaatctgaatctgatataaagcatcttcaatgttagtttccagtttatggatagtcttaaagaaatttcctctccaggtgggatgaagaacatcaaatttaatgacttgtctatggtatcatcaagtggtatgaagggagatatattgtgcatattgatttcatgagaacttgaggcagccaataaatgccatttggtttcatatggattattaacatactgtctcatcatcggtctgaacatgctatctatttcgtcagagaaagttgttttcaaattgaaggagattagcgaggaccataaatttgggaatgctaggccatggacaaaagaatgtttattttttaaggacattctaaaagggaataaagatagtttccacaatccgtcgcttgcagtttcaatgctcttatcatcgctatactttgctagaacaaagtcttccttctttttcattgagccctggaaaactattatttggaaaccctgcaatagagagccatttaatgagataaagcgaaaaggagacaccgattctccccatgacgagtcagttgggaatttttgtagacttgtggagtgaggaactttggaaaagcttgaaaatccgttaatacaatcctttccatatatgtctttacaaaagaaaatatcgaattggacgagtgatgtgagcatttcgaagctatagtcgacagacttagaaatattgaaggcatatcctgtggacattgattcagaagagtttaagacaagtaaatgattctcagggacactttctgtgtcgctgaaatctacggctggggcgcttaagtttttatcgatcaatttatctgcatcagtaattctttcaagtccactcaagaaaaactttcttcctttgcgcattctaatatctaaagtcgcggtttttcctcctgcatcatcattgacaatttcgagaatatattttgccaaaagatatctcaactgatcacaccacactattgccaaatggtcaattggggtccatagctccggtattgtagtagtgaatgtagtgaagccatttgattcaggaacaataccttggagatttgtataatcggcaggcaatatgtcatccaaaataccacctgttatggagatcacagaaacattgtttcgaaaataactgcccatatcattcatggctgaggtccagtatgagtttaccctgtcataaagttttagaatatcaccatcaaaagtgacgggggctgttgaatgaggggacgacaacgtcaggatggtatttacagactctggtatgtgattcggtagtgtaagcattaatcttgccactattcctcccatggaatgccccaataaaatgacagatttaggtagtgggcggttggattccttataggcagcgctttgagcatacattgacaagatatatcgtactgcatcgttcaagtatacagcctgatccagcattgtttgcccatgaaaggcagtgaaatcctcattgaaatcggctgtgaaataatccatgttctttgcattggaattttgaatagttgatttatggtcaaagtataaattggcacttgccgcagctatagatctagcttgtttgaaacttcctgcattgccgggaataaaaaggacaggtataccatcaagctgtatttcatcaccatgtttcggctctttatctttaccttgttctctgtataggtagaggtggtattttttggcgagtttagtgtgtcttgaatcaaatccatcaattctggcgtacgaagggtacatatagattgatctgcatttaggtgtatctgatccgctgaaattatgagatatatgagtggaggtaataatgcatagcagaagcaagcccactatgattacaagcgtgcttcttttccttagtttcttcgtcaatgtaggatacctgatgcgaacagcagactcagccggtaagtcaatttggaccattttaacaactggcttggtaaaccactaccagtatcctaggtattattctaaatttagtgttcctagtgaatgcactattctgggcatagttcatcaatcaatgcttgcaatggtacataatgttagatgcaagatgccgattttagatgcgtaaaccaaaaaaaaaagaagctgaagtcagttcagtcacgtgatgtataatgcagctcacgatgcttaataacatgaattatctatattgttacagattcgcataagaatgcggaaaatactaattacaagttcatatttataatgggatttggtgtcatcaaaagtttacaatttcgttatgcagcagcgttaggagtaacgtgtttctttggcggactggactgatttggagttgatcctggattcttcctagtgtcctgatgagatggtggggaagaggactgtgaatgaggagcattgttaatgggctgttgacccttttgtagcatttgctgttgttgcagggaattcagtttctttcttttgttgatttgttcctgtctatatttgatggtggcatctcttagttgctcgtatgctttggatcctaacatggttccaaatcttaccacctgagtatcgtttgaaatttggttcaacttcgccggttcgtcggaaaacttggacccgtaaatgttgtaattggaatcatatttccagtgataatatgacctggataaatcatccagtttagaatcatacacatttataacatcattatcgagttcttgcttctgtattccatccaaatcaataaattgtaataacatgtcgttaatattgtgatcagtttttctttggtcaatatattccatattgaaacgaccgcgacggcgtctgaaagcgattggaaattcacgagaatgagtatgaatctcgttatcaaatggattgaaaaattctaactttttatactcattgttctccacagcttcaccttccttgttaaaaacctttatatcattcgcagtgccagtgatataattttgaagattaggtgaatagtaggatgtttttacttcgaactttgagccagcaacagaagaaaatggagcatcttgggggctgacgttatctggtattgaaaggttgaaaacaggattgtaaggatcatcagtgaggttgaaaaagatgtcaccatcttcctgtttcctttttctcatcctgtcttcaacaaatttccttgtgcttttttcctttgaatgcaacaatttaccgacatcttctaacacgatatcaggtatcttagagttaggcaatttaacatatacttgagaagatgcctgtttttgctgttgttgtacattcgagacattggcaacaggcgactgagctccaatttcctgcgcagatgacagtgattgttctttgtttttatttgaaccagtttttgggcctttcttctttggctcgcttcctttctcatcagcatatagaccactgtcttctttgtgaagtttcgacgattttgaagattttgcacgtttaacagatgaatctgaagtaatggctgcctgctgctgttgtagttgctgttgttgctgctgttgtatctgtagctgtttttgaagaagaagttgttgttgttgtttgattgtacgcaccgaactcacgagtttttgtttctttgccgagtacaaatcctcgttatcggcatctatgcctaactttctcttcattgtcttcaattgggctcgcgcttggaagacgaacttttcgttttctaggacttctaatactgctctttctcttttggctacagtgagtgccaaatctttagtatattccaattgttggcatagaagtcgcaatttttgtgagttctgaacatctatccgccttgttttcctaggttgtcgaagctctctcctacggaaacacacatatggatcattatcgtctttatcattattacgctccgatttcaattgtgggaagatatcgcaaccatgacgtgatatcttgcgttgcttccaatgatcgtgtattttctctccgaacaattcgataagagtctccatatttttttcccttttacctagaggtcttttattgtcaaacattgtcaagaatggttcatcttcaggcatcccaatttccttcgcgagttccttttttacgccagaatcaccaacatcgtttttcaacatggttggttttaggtctgcaaatgaaagtatactctcgggatccatggacaggaagggttgcctatctttgatggaagactcaaagttggccataattaattcaaactcatcttccgttagaggttcgaccgaatccgccagggatttatttaaatctgccaaaaagatttcgtcttcttcatccatattatacaaagtaccacagcaatcttctaattgtgcagaaaactggatataactcgtaggacatttgaattcaccttggtaaaatctgtcaaactcgtcccaagttttcgaggcgtctggtgttggaataaatagatccttcttgttctctcgaagctgattggattgaagaattttgtataaatgctcttccttttcttcattcttctccacaccagtttcaatctccatcagctctcgctgttgatgctgggaactgatggccgaaacatcttcttgttccaaatccttaatttcatggctcttatagatccgaagtcgttgcttcacgctgatctttctgtgcctgaacctcgatgaatccactgcaggagctggcatactgcaatgtgtcaatgcccgtgtgtagttaccctgatagctatgcggctgaagccaaagaaggatctttgaattccagatttcaatagcgagaaatatgaaaggaagggtaactacaattatccctctaaaaaattggttcttttacgggggcccaaatttattttcttcctgttttcggggccaaattttgcgaaaaacttcactggcaagcaatcgggtggcggtgaaggaggcagaaaacaaggagaccaaatctaaaataggactgaagatagcagctattggtacggattttgcagaactgatgaaagtccttaagtatcactactgatggttgattctcagtaggtttgaacgagccaccggactgttctgaagcgcgtggttttcctttttatgttggttgtttgggtggaacgcaacagtttgtccggtgaatgggggtattggttttttctatattgaaatccgaacttatggaaagaaaaaaaaattttttacgtcttctacggaaatatgaacgtctcccataaccaccttggtagacaataggaatttctgttcacgtgacttccattgggtcaaggtaaatggtgatgccaaaaattgtatgagcttctaccaaaaagaaaaaaaaacggaaatcagtaacttgacatccgtaatgaagtcatctcatcgcttgttgaaagagtgagttatctgaggcaggtaaagaggctgagaaaatcagtcttagtcgtgaaacgcaatggaaacagcagaaggtggggcttcttttgccgagttaatggatactgtcaaaggtaccatagataatttggtaaacaaaagaaccttcttaaaggaacagcagccgttgtatgaacagatattcgataggataagagatgctgacacgagcgaagattcggaagaagaatggcagtatggtgaggtagtatttcagaatggtaagtttttccaaaatataggttacgattactatttggagaaatctagggaagaatgcctggtttttataaaggttcgattgaacttaattgccgaagccatttcacaatttgatgagaaactgaaagaggcacatggcacattgcgaaacatggagttacttcgagacggtgcaaaatctttgggagatacgaatgtttctaacaatgatgatgaccaggaaggtttctttgagatcagagaagaattagacgaagacggaaatgtgatacatgcttcaatgacgcccgccaataaggtgcattcgggcaaaggtaatgaagtccatagtgatgaacaacaattgtcactgagtcaggaacgtcaaaattgtctttcaccagagactgccttcaatattcagaatgatgatcgctcttccgcttcaggaacttcggaaactggcaataagacaggagaaatcatggaagcagacaagagtaccatgcaaatagcaaaggaaaacatgtacacattcgatgatttggtagatcagttagataaattggataattatgaagatggcgaaatcgacgtaaatgacgtagaatacgattttgatgggtatgatgaagaaagcgacgataatgaggaagatgaagattattccgtctccatagttcctgaaagagttcagcattcctttatggaacaaatacaggctttgagggccaacaaaaaacatgatctcgtacatacagaatatcgtaatcattcccctgagcaagaagctaagtccatacttaagaaaggcggttcgaagaagaaaagtgtcaactttgcgccaaagctagacgtctttgaagtggaaaatgtgaaacaggaaaccaaatctaacacatttaatttccctagaaacagctatatggagtcagaaatcatcgcatctgacggagaagatgttgaatttgaccccgatttgttcgcgcagatgatcggagccaaggaagccgacgtattgcatgaaaagtaccaacctggtagcatcaacggcttgaaggaatctgaagagccagcactcgccgcacctcgaaagaagcgtatctcaaggtttaaaaaggaaaaagccgccacggaaaaacgcgagtttaatactaatgatgttgaaatgtttgaaaaggaaccaattgtagaggctgtggtaaccgacatagttgagcgtgacgacacatcatcgatttcagttgaaaatactccgattaaaactggttcgccaaactttattcataagaagatgaagtccttacaaaaaccaaaatcgctgccaactaagacaccatcaataattcccactgaagaaatgaacaaagatgacagcggtgctgagggcgaacaaaacaactcgtcaattgcggaagtcatgaaggagaagcaagaactagttgagcctcatttccctgcgcaaaagtctaatgaaattcatgtccagccaagaatcgactttgcacaattggacaaccttgatgacatggcaagagcatatctcctaggattatacgatgacgatgtagaagatcctggcacagtattgcaagacacttctgactttgaggcttataacaagatggtagaaactttgaagcctgaattaaatcagttcttgaaggagaatgcaagctatgaatatgacattgaactgccacaaagtgcagaatcatcacagaataacgagagcactattattaacgaaattaaagaaagggatccaacgggcgctggagaacagccagtacaagacgttgaggatcaaatcatatacgcagaagttgagcgagaatatatggaacatcgtcgtcgaaatattgaaagattcgcggtcgcatccacctcatcatcctcaaacaccgagcacaccatggaacttgagttaaatgaagagttaggtaaagaaccgattgatgaatttggtaacccggtcacgaccagccgcttcaaagcacaaacgcttgctttgaagaaacatcatctatctcaacagcatccataatatctggtatgtagatatttctgtaaaaactttgcacgtgatatgagttgatagttctggattacttttagagaagtttaccacaattggtgcctctcaatgaaaaggtgctcggaccttcttaacacattttttgggcggaaagaagttccattttgaacatttttacacagttacattgaaatagccaaaaaaaaaaaaaaaacgtgacactcagcagcccgttcctgattcttggttatctacattttcttctgtaactgaggaataaaaaccttgtctcgaactacagaaaataacgcagcgtgtttaagacaggtctgaagtttattttatacagaaaatcgaaaaactccacaatcagtcacatcacgtgattattcctgtatatcaaaaactgaacagctttacaaaacgaaatcactgtcattggttcgtttcctagcggacagttgcttgctccctctggtacgcatactaacagtttgatatcagagagctgtattggtatatcaactcaagtgtcaactacatcaatcaggtaatgatgtaactgtgtcagttaaatcccatcagccgcatgacatgaaaaagccatttagcggtaggtaagccatatcctatggactgaatagaaacctcccgtcattaccaacccgcttggaaaagatttgtaaaatgattcctactcgtctcatttcaggtgatttctctttcccaagttgcgtatttcctggtgtctcagaatgactctcttttttttttttttttttttggtcaataggatagttgtacttcgatttcaatgtttatttttcattctttcgtgcatgaaacttccttccgatgaagttccccattcaatacgccctgcgccgtcacgctccaaaatgtgtgatttgtaatgtgcacttgactgtatactctgcaatcgtttgcctcgacttgtgtcctgcactagtttctctattctattccactcagattatcagaaaaacccaaaattaaacagaaacaagaaggaaagaagtatcatatcaattttctgtgtaatgtaaaaatgtgtcttcctctggggttttggaacctttgagacattacatgtttgcagattgaacacctttcttgttataaatagcagatgtagaaattattcacgacaccaaagatatgtaaacagatgaattatgttacatataatgctggtacgggaactctcatggctctttcatcttttatgcttgcacataagttaatggtcaatagcaaataagcagctagagttcaaatccatcttaatagcaacactaaagaagactaggcatccattcaataatcagcattaggaagagatacatccaagtgcacccaccaggtattttttttttttgatattcctttccgcttcatattataccgacacaaatcttagatagatattcatatgaacaagttgataatagatcctaaactgaaggcattgatggatccagattttgtttatgattccgatgagaatctgaacgtggaccagggtgaaaccgtgcatgaccacgatccattgcaggattttgacctcagtagaaagtacgatgcggctgtggcgggcgcgatatcgagggtatcctctccgttaggagattgcgacggtcacgtgacagggtcgtctccgatcatggatggtagtagacattcacttctgcataagcatgatcatggtagtggtcatggttacagtcacgatcgtaggcatagtctcgtagacgttcacggacatagtcatggaacccatgctacggtagagcctgatccggatgaacgctacctaaacgataatgggactttccactacaccagtcaattccaggcaagaacacacgctgacaaattcgacttttaccagggcccaaaggagcacttccatggtgcggtgaacaaatccttaagtctaagaaatgcagcagtgtttgacgaaggtgagtctaactcaacttcaatcatcacagatcagcatcatgctctcaatgaatcgacggtaagcggatcattcattcatcaaaatgatgcacatcacatacagaaccatgggcatctggactctcattcaacgactagcaagaaatctttttttgatgatgaaagaggatataatgacggaaatgataactttacgggaaacaatggcgatagatacgaaaatggaggtgaagatgaaagcttagaaagtgatgaatatgattctgcaagtgacgtctcagaggaatatgagtctcagttacataacctcttccataagataactaagtttaaaagcgatttccaccagctgatcacaaaattagatgaggcatctctggaatccgcaaaggcaagacagcattatctaaatgacatcagtatcagagaaaacatgttcatgtctgcaacgacgaatgtgcttctagatacggtatcaaaacttcttccacgtaaacgaacctcaaatggaatcaacaacggaaaaagccgtggatcaatgtattctaatcatcccttatcgtcggatgctaacagacttcacggtaagacaaacagtaacggtactgctgaagcaacaaaaaattcaaacccccactccaacaatgaatcaatgagcgcactgtacaacgcatccctggaaaatgatccatgttctaagctacctaactttggtgtaatattaatcaaatctcccacaaatgttgaacaattgtggagtgaatataccaaactgccatcggactccaatatgaaagcattgcttaaattgatgcttcagcaacaaaataaagataccattaagaaatcggatattgcattaatgaaacaaaggaaaacgaccatccaagaactagagagaaaatgtggatcttcatggagaaatagcgataaaaacttttcgagacaaattaaccgcaggaagaaaatctggggttgcattgaacaaggtttgaaagacgggttatccctacagacttgtttccccattcttgacaaatacgttgaagaaagggggaaaggtttgtcttggtattataatggtgttcctttcaagttagcggatctagcaccttcttatagcaccgaataagtgcagaaccgccgtctcatatattcaattcctttaaatacatattctttacataataaacaattctccacatatatgcgcctacgaatatacaattatttgcaatcaattgagaaattgttatctttccaattatccttcatggagattcggtatgtttttttactatttatcggcgactggacgtaattatctgtgaaaaactgcgtcggttagaccctaacatattatcctttttcacaattccacgcaggtaccaaaccaaaaaaaaaaaaaatacttagcgagattatgttctaaaaaaaattgtcatcagtcatctgacagttttgaccctcaacacaaaacaatttgtatgccaggtatagacaggggtttatccaagcaggtcgaagtgcaaagagtggagaggcccgacaatggaccaattagtttgtcttattgttggtgatacacctagtactctgttgttgtcttggagacttagtgtgtcaaattgttttactatattcgtttcaggttccttacctggcgatggaataatatcgtggaaatccactaaatcaagctctggctcctataagccgaatgttaccgttaatgattttgtagctctttccaaggtttacaagaccggcaaaattgatatcattattatatccagtcaatcgatatcccaattcaacaatcaattgagatctttggaaagatttattcacgatgacataaccataataatagacagtaatttcgcagtggagctcgagattttgagtttggctaagtacccaaatgctactacaatatccgttgttacggatgctgaggtgaagcgactttctgttggatcgtatttattgatgagtgaatcaacttcgtttaaattcgggatttcttatgactgcgacactaaagaaaaagttcttaaagagaacgtaaacaggtacaataattattcacaagattatggaagtaacttcaaggtcttgcttgaggttttgcggagaggagacaatatgagttctgtcgatgttattttggcagaaaataacgtgtttggacttttggtatgggagtggttgatacctaaaatttcgctgaatattttagcaatagtatttgaacacgattcatatgatgacctattggaaaatgattcgaatgcaaaagtattcagacagttagttcaagagttgatggatatatattttaagcaaactaatggggggataatcagatcttacatttcaaatgaccaaaaaaaaccagagtataatgctgtagtacagcggttaaaaaatagacaaaggagtttagaaaggtcagttggaaataaatatccgcattgcttgacaataaattatgaagcatactgtttttataatgaaattgcgtatccatcttcattattgttcgaacagtgcattaatctagcagacaaatatgattgtggtagcagtaacttgacctttttatcaagtctttattgcaggcaaccgaaccatggtggcacaccactgaaaaatgaacacccattagggtccaaaaaaacaagctttctgcgtggaaagaagacaatagttaatttcgaacagaggagtttatccacagactattctcaaattactaaaggaagaccaaaaaaggtgaaagtaaaaggaaaacaaaaatcttccaaaagtactttgaaagtgacatcaaaatatgatcttaaatcgccagacttgcaattgccacaggatatacaagaaatgtatctcggatgtgactccataaatttctcattgcctttgactccgaaaatgatagatattcaattcgataccacatctgatgatcttcaagaaagttcggcttcagacgtggactcggatgaatcaatttcagttcatccccgcagagaaaggatgttatctcaaaggagtttaataagggtatcggcaaactcaaatatgcatgaagacgacaatattgaccctagcttaaaattgcctttatttaaaggtttcaaaggtgctgtacagagacccatgacaaccggtagattggaaatgacagatttggaatggcagcttcgtaatggttatgcagacttaccgaagcaaatgctacgagccacaaaggatgaactcaaaaataatggtgcgataagacatcaatcgctagctggacaatactggaagctgatcaagcagcaacacataaataatgggcaactagctcgacctattaccagccaggaagacattcttaggtttcattgcgaaacattaacaaaatcacaagtacatctttccactactactaatcgatatggagatttggattttagtgacaacatatttgagcattggaaacaacggaaaggtagtctgtatagattactatctgacaggtgatttgaagatatgaagcgcatatatagattttataaactaccaaaagcaatttagaacaatcaaggaaaatcattcatacaaatcttcatctaacctagcggcagggttcgattcaatgaaatccaaagaaaccttgtgacccaaaagctctctaatattttgaaccttgtatttaatcattgtaggtctctctaaagacaaaccccaacccagaactctcatatcctttggaaggcccatggattccaacatttctggtctgaacataccggagttaccaatctcaacccatttgcctaacccttcatgccatgaataaatttccaatgaaggttccgtgtatgggttataggttggtttgaaacgcaaccccgtaacacccatcttagcgaagaagtcttccatgaattggattaagtcacccaacgttatattgtaatcagctaaaacaccttcaacttggtggaattcggctaaatgtgtagcgtcaacagcttcattacggaagacacggtctatcgagaataatctggttggttttggatctttggccaacttatgaagcatagcagcagatattgctgtagtatgtgttctaagaaccaatctttggcactcttcctccttccagttgtaacggtaaccaatcgaatcaaatttaccattctcgtgtacagctttgatgttggcgatatattctctatcatctggcatatcgcatttgattgggtccttcaagtaaaatgtatcttgcaaatcacgagctggatgttgttgtggaacgtataatgtgtcaaagttccagaatcctgattctacgtattggtttgatggcatttcagtgaaacccatagagaagaaaatttgtctgaattcctctctgaccttgttcaaaggatgcagagcaccggattgtggatcgataccttgagagttgaaattgaactctttgaaccttagatccttatatgaacctgtggctaccatttcagcggtaatctcagtctccagcttagtcaaatcggtagagaattccttgcccttgacaacgctgaatgtagtttcctttcttggggtgattaactttctcttctttagatcagcaacttctttatcactgataccagaaagttcgttattcttaatcttttccaattgttccttggtttgatctttcacttgggagacatctgcaattttgtcactaactttcaattcattttctggtgtctttacaatccatccgttcttgaaggctctagcttgaccaaccttcccgtcggcgcctagatgactggcaacatctttgatttgcaattttccaaactgatcaatcaatttcaagagtttcacttcatgagaaccatcggccacgatcgcattaccttctttagttaaactgtagaaaatggtatctttctttgagaaatcgatcttttcatgggatttcaaagaattcaaataagcagccatggtttgagaatcgatactggggtacagctcagaggttgagtcaatttgacccaacttttcgactttctgtaaaatttccaattgaatatcagacatcgtgcaatgagtattaattgaatatggtaacggatgatatctttaatacagaatcactactgtatcaaacgtttacgctgaattaccacgacaacgttatgccagaatctgccttagacgagtcaagctttgacgtgcccatcaagtttgttgtatttgatgttcgaacagaatctgatttttgttctgtacaattaaatttttcactagagtgaaaaagacctgtagtagtgacagacgttcaaaatgatatcacgtgagtcagtttgcattcctatattgtaatgtaatgttacgtacatatagcttcattataattacagtagtgtaccctttgattcatccagggtgatttggtttttattgagaagcgggtttgattcggcacaaagatctagccttgtgcaagcttctagcatgatctcttttaagagaaaccatttcttctcaagttgaacagcttctgtataatccttcttaagtttatcatttagttctgtgagccatttcttctcttccagcagtgtggactcatctaactgtgcatagtccacgttttccaaagctgggtcttctcttttccatatatcgatatagtcttcgtgcatcttattgagtgaatccttatattggatcaacttaagcctgtttaaatcttcaatttcttctcgctgagctagctgacctggaatatgacgaatcacctcatagtttatctttaacgagtcatcaatggctactatatgtcttttgttcccagatttgcgatcctcgtcagcagatgtgtgtagaggagcgttcttataacgagcaatggctcgtttacttctttgtacttgtatattcttaaggtcttccatggatctctttttgttaattatctgttctgctgtcagagccgttacagtcatcctcggtggcttatttgtgtttgtgtgtgtgtggagttttctttactgctcttttttgttgttgattttggaagtatgtaaagatgcatatgacttcttagtttgagactatattgtagagacaaagaagacgctaaaagataaatattgttttagttgaaaggggagctgtggagagtacaatttatttgatctttctgaaccgatgttaaagaataagtattagatggagaatctttcatcccgcacgtgaccgttgctttcttttctacgacgaaagtgcatcaaaacatccgaagctcagaaggtaaaaaaaaaaaatagttacatagctcccagctcatcgccttaacgaggtgatagaaagagtgtgataaaaaccatttagagtgcgtcctttgataagctaaagaccctcaaggacactaaaacccaaacaaacatggacagccttaatgtagatgaacttttcgccgatttgaagcgagtagtggcggaagagaaacagagcgatgagccaactaaaggtgatgtcgatggcttccatgatgacaaactctcagtagagattgacgacaaaacggaacagtttcaagccatcgagaggaacttgaagagactgcccaaacttcaaactggttttgatcagctgggaaccaacgggaaacaaattcaagttgaagagcaaagcaaggttatcaagatcgatgatccgatatacatcttagaatcacgtaaaaaatcagacaaggtaaaaccaccgacagagactgaaaaatggttcaccctaccgaaaaccgagatgactgccgaagtgaagcgtgatttgatgataatcaagcacagagccgcattagatccaaagagacattataagaaagataaatggaagattcctgagaggttcagtgttggtacaataattgaaggtccaaccgagttctacagcagtaggttaaagaacaaggaacgtaagaacacaatgttagagacgttaatggcagacgacacaacgaacaaatatttcaaacgtaagtacaccgaagtgcagcagaagaagacaagcgggaagaaagcccactacaatgccgtcaaggataagagacggaagttttaaactaatgtacggctaactataaatgtatagaatgtattatgtattcatccatattactctgcttgcaacagaaacgcatcacatttcgattagtagaagaagaagaagaagaagaagaagaataataagggcacgtgatcttatttgttacccggactcgtatggaaaacaacaaatcccacagggaaataaaaaaggaactaagaacacccacacctaacacgtaatctcacaaaagaaacgctgctctaacctctcccacttctacctctatctgttcatccatctcctacagtgatgtctaacccctagtaatctcggttgctacgtgtacctggttcttgtttgtttacctttagattagccacagagtgaaaagcctgactgagctgatagtgggaaaaaaagaagattggatagagagacgaagaaacaaggaaagacggaacagacagaccttgaatttaggttgaagaacgaactgctggaggatttccacgaccaatggttccaaaaaaactttaacttggctgaaccatccttcttgtggctagtccggcatcagcggaacacacacatacacacagtgggaataccaggttcccatttcacattttacacactgccgacgcagaaaacgacgtagaaactcacacttcgttcttccgcttatggtccctctgtttctttattttcttaaaacttatctctttagcacaagtacggtgactaacgctaccgccactactaggttttacggagcattccaatcgaaaactgcaattcctcagttattttcctctggaaatggaggttagtacgtcggacaaactaactagggtaccagaaacaagaaaccagaaaatctctgtaaactatgtgttttcagcactaggtcgatccactgtggctattatttgtactttgttttccttgactggtagttggctagcttgattgtacgtatttcacttttcttgtaaaaaaaaaattactgttcctactttctcagaatactaaatctaatgaattttgttaacggttttattttttgacttataagaaacgattctgacaatgagtccctctttatgtatattttgacataatctgctttcttcacaaaggtaagcaagaaagacgctttttttctcactgacctgtttgtgagtgtgtgagtgtactttgtttgcgctgttttgacctgcttcaatctggtctcgtaccctggaatttagttataataagaaggtaaaagttggaattattgctcgaggaaaggattaatagccagaatcagataggaaaaagtcagaatatacctaaggattaaaaaaagcgctttcgctgcggatttgtgttgacacattatattattaaacatatattttgattgcgatgggcacagaggaatattcaagaaagcttcaagaagcgattcaagacccgagcaccgaggcgttatggcgcatgtattcgaaagccaaggcctcgttgccctatagagaacgaatgtcaaatttgacgtggcgtatgatgggtatgaaactccacaagcatgcctcatccggcggttcggataaaaacaccggtaccgaggcatctggtgcaaataccaatactgcgactactgtatataacagctccaatggtggtaataataatcctttgaagtttgatggggtctcttttgcactacacgattggaaggcttcagaactggccagttcaaaccatacaaatatagcgttggatcctacgctctcgtttctcgatgggctcactgaacttccccctcatcattcacaacgtgagaatgagaacactacggaagcagtggaagacgttgatatgggtaaagacatagacaatgctgaggatgatttcgattacgttagccatctgaaacgtttgaacggtagcattactgagagtatcaatccaaagaatctaaatgccgatgtatcgatgtccaattactcatcctcacaaagcgaacaatcgaatccgcagttgcattcaacagcgtttgacggtcattacggatcgttttcggatcacgatagaaacgtaggatttatgtctatggatctcaatcaagttacctccgcttcttcagattaccatttgatagaacatttacaacaatcagaacttagctcacaagccgatgatgtgttgctcaccgatggtactcaaaactctagtgcatcgccggcaatgataaatgatggtaactctatttatgcgaaacacactaatgatccttccgatccatccttgcttggtggatttagtcataaggggacaggttcctttttcgatgactcggatatcatgacttcttttaccggctcttctagtctttccactttgaagaatcccgactatgactcccaaaggccaccattacattctactacttctaccgcttctttgaaagaaatgtattatcagcaacagcattctcaatcacaatcacaattacaaagacgtccctctactgcggtatcttctgtaaacccaatatccattaggaaaccaactttatcaagaagtaacagctcattcggttcttctttaccaaataatctatcaataggttctggaacagctccaacttcatacatgtcaacttctcaaggaacaagacgtggatctttggctaactccataagaaagaagccaattaataagacaggttctagaagatcatccgtttcattgaaccaacttaacaatgaaggaggagaaaatgccatgggtgctaacagtggacaagattcaggagttaagacagaaactcaatgttcaaattgtcatacgaagacgacacccttatggagaagagatcctcaaggtaacccgttgtgtaatgcttgtggtttgtttttgaaacttcacggtgttgtaaggccattgtccttgaaaaaggatgtgatcaagaagagacaaagatcatctaacaaatctaaacaagtatcgtcacttttaacaagtggattagcatcaagtaacaataacagtaacgcaagcatcaacagcgggatcaacgagaataataactctgcgatttctaccggctctccgacaaacgccatctccccagataagaagagatatgctttgaagaaaaaactgggtaaaccaacaacaccaactgcgaacttgcagttgcaaaggcagggaagcgcctctccatcactgccgcaaaatgctcttttcaattttcccagtctcggtaaagtagaatctttcaacgatgaatcaccagcaaaatccgcgcagatctcgaacaatttggaaggttttatggatcaagattttattcgcaaacaatcctcccaagtagagaaagataatcaaaaatcatcgcaatatcaacatcaagcggaatcacaaactgaaaatccaaaaaacaaagggaaaccccctggagatgtaaccagctgggaatggttgaccttgtccttataatttaattctctgattactttttccctaatctaataatatccatcgctcgattcttaggcaacaggtttacttaagattatattctgttcatagtttcagtttcccagttaatactaacttcaagggttttttataaagttatatcgttcatttaacagatgttgattacaagcttattattctcggtaacaactttggaatagagtatcttcttcacatgagttgctcatatgtatttttataatcacagactactaaaaacggagggaactatcgtgaaagggcaaaactgctattcaataacgtacttacaagtcatactcattaatatatatatacatgaactcataaagaggtcttacattggacctaatttttagtgtgcttcttctttgattttttagaagacttggacgcacctgggccttcaatgaattgtaaaagttcatcaactgatttgttggttagagcagggctgctgctggacgattttttacctttcttttgagaaatattagctggtttagttgcttgctgagcggaagcgagtttcttttcttgttgttgcttagtaataatacctttaatagtttcggaccattgtttcgaagtcaaggtagtttgatcatttaaccctaattctttcgagaaaatggatttggctttctcaatatgagataatgcatgagacatgtcatccaaagaggtatacaagttggcaatacgtgattcattttgaccatatggtaatgtttcttcgctaccagtgatctttagaagcaactcagacagcttgttcaaaatcttgatctgaactttcttatcctcagtactagcagcaatttggaataataaattgaatacattaaccctaccagagtggacaaaaggagctaaaagcttcaataattcatggactttcttcaatacaagcgcagagttgtagatagagccttggccgtattcaaggtatgccaagtttgacaaaattctaacggtttcaaatgaatcaacaccgtaacacctttcggaaagcaaagcagccttgttacagaaagtaacagcttgtgaatactggcccaatctagaatacatattagaaagtaacaaatacgaagaaacgagtgatggatgaactaaaccgaaaatatcttcacggaatgcaatactttgaccaagcaaagtgagagcttcattcattttcttcgcacgttctttggcttgctcttcttctttcgaagttgctccagaagatccggcgtcctcaccgtcagctgcagctttctttgattcttcttttttcttctcagcctcctcctcttcaacacttacagcattaactagagaagccccttgaatccacaactcttcagcaatcaagctttgaaattctgctcccttgataactggtcttaaagagaaatcattaatagaaaatgtttgttttggatcaacgattttgcttctcaattttttgtcttgagcttgtttccacttttcatattgttctttggtgaagaagtattccttgttgatcaattgaataccgaacttttgggcgatggccctgattaaagcatacttggaaaacctcttttcattgatatcgaaccattcagaagttagatcgtaacggaaacgaagttttgcttgaactctcacttcttcaattagttgttctctggtgtattgagcaaattctagctcattgatatcgaacaaagcatccaaattttctacagtgacactttcgttgtaagatttaccaaacaacaagttcaagaaaaatgcaactaaatgtggcacaagagttggagatgagagttttttgctttgttgtctaaaaatatgtttaatagaacgagcgatcatctcaagttcacagaccgcgatcaacccttcaaattgatctacctcgacggtacagccttcgttcctgacaggttctttcaaatctgctttgtcaagctggatttgttctttcaatttggatggaacttccttcccttgctgaacgtatttgttgatctcctcttgtctttccttgatcaatttttcaactttaacaaggtaaccagtttcccaatcttgatattccttgttttcttgttcaattttggaaagatactttgctctctcctgtttttgatcttcatatttcgctttaacaaattcgatagctttacccaagtaacgcatgttaacaccattggtgtggaacaaatcagtaagatgttgaccatcgtatggaatgtttgaatttccttttaaaatatcttctaaaaacaatgtgagaacagtgtcattcaagaatttggacatatcagcaacgttttcatcttcgacgccatcaatgacataggcatccggattgtagatgaaagaaacatcttctgatgcttcttgtagagtctttccggatgcagcgatcttctcagctctccatctttcaacaagttcacgacgaagcaacacctgtctgtgaggatacttattctctttaacatcatcatagtgagctttgacgaattcaatatccactgggttggtgttggcaagatccaaaatgtacgctctttgatcgacgccgaaaatacccttggatttgctggaaattctcaaatctacttcttcaaccttgtgttcttttagatagaaattctttgagaattcacagactttttcatggaacttttcatcaaacttgagtgttgcgacgaaatcatcataaccgtaattgacagaaattagagtttccatgggttcagcaacttctttatcctcttcatccacgataatgttgacaccgactggagtcaataatccaggtactggagattggactaacaaacggtgacccgcgtaatcaattatggctgtcaaacaatgacgaatgcccttcaaacctagacgatttagactgttgattatttgtaagtcttggttagcaacggcatacgcagcttcattaccaccaattgaagaataagtcccactcacatcggcaacgaacgagaaaattaatgatttgtggaaatatactgcattttctccggtagtacccgggtcgattggagttagttcattgttgaaaattgccatagcgcctttcactgcttcagagttaaattcatggatcagccctgcggtaatcttttcattcttcaaacggtcataggatgagttgatctctaaatctttaatggcttggaattcatcacagaagttcctttcgtcatcgttgttgaagtgctccaattgagtgcgcatgaaatcgccattattagaaggcaactgggaaactagccacggtttgctcaaaaagcaggaagcaggcttcacgtattgtgcgctatccgtggaagacaacttgtttctcaaagatgtgacgtgttggtggaacttttttgaaacttgagtcaaaaggtcaatgagattaaactttggttcgaattcatcttttggagatgggtcaaacttgacagagctagatttgttaacgtaaaaaccggaaatgcttgtagtaatgtggaacgtttcattttctagagtgctagcttgtaggtacaataaatggcccttattcttatagaaagctggaacagggttataggcagaaaaatgtagggactttagtactggagtgaccaataaattcccagttttcaaagatgcgatgttgaaatctgtgttggtagattccaataattcgttgcatgtttgcaaaaacttgactttttcttgatcggatatagtggtttcagaaccatttgacttttcggaattaggttcaaggctcatgtcctggaactgagaaccagaagagattgcaaactcggaaataccatcttctaactctgaagagaaccccaatgtttctctcaagccaacaatgtgttgcactgcggtgaccaagttatacgcctttggtttaaattggaaagtcaaagatgaaccgttaccagccaaatctcctaaaacgtcttcatcatctacaacacgactgttttcaatcaagtcatacgaggtgtagaatttagtagattcttcaaatgaaaggaaagtcctcaaatgagaaacattcgactctttacccaattgatactttatatcagaattcttggacttagtgtaggacggagtgcccttcactataacctcaatgttatctgctgacatttcagttggtgaacaaaaattcaagtctttaacactactttacgggactgagattcaagtccttttgcgaagtgttacttggtaatatgaggcaaataagattgttaaaacaggttcgaatgaataattaaatctcaaaactatactctcatgattatgctacttgaaatatttcgacaatttttttttcaacttttcattttccagttttcgaacgacgtccgtcatcggaccaaagttatgtatataatgatcacgtagaaagaagagttgatacaatgaaacatttggctagttatgatgttaatgctaggctaagcattgctaacttcaacggtaaatcattagctacaactgcctgaaagataacttgcccgtgcgaggaaaactcagtgcccttggagcactttaataaatggatataaaaaacaaaaagaacactccgatacggggagtcgaaccccggtctccacggtgaaagcgtgatgtgatagccgttacactatatcggatagtaactttggatgagtaactgttaccggaattcacctacattaccacggcaatgtcatgtgaatgccacatgtgcatacacatatatatatatatatatacattacatacattatgtctccataagtacaggctgatataacagctcatgctaatgaaaaagtcattcaaaattttgatgattccaaatgccctgtttacgctttttaaatatttaattttagtgatcagcattgagagacattcaaaatatgtttgcacataattagtttaagatggaccaaaccaaaaaaaccagactgatataaaagagtcattatatggaccgcagatttaagtttctatcgacaactactctaatttaactggtagttgtgtgctcagcttataatgaacttcataaagactgctatttggggacctgatcccaaggaacaacatcgtaaacttaaatcaatattaaggaagaatgatagacaactttcgaaatccttaaatgagttatcttcgttgaaagccaaaacacagcagctcatcaagcaagctgcgaagcagaacgatatcaagacagtacgtttgtatgcgaaggaactttaccatgtcaacaaacaatacaatagaatgtatacttctaaagctcagttacaatctgtggggatgaagatagaagaatgtttccaaatgaataagttacaagacaaaatggcacaaagtgcggtattgatgagggatgtaaactctttagtaaggcttccacagcttcgtgggacgatgatagagttagagaaagaattggtgaaatctggtattatcactgaaatgatggatgacgctatggaatcatatgaggacatggaagaagaagaagaaatcaacgaacaagtagaccaaatcgtagctgagtatactagtgagaaattgggtaaagtggaagaaacgccaaatgtcgtattatctgaaccaccaccagcagaacaagaagttgtccctgaatcaaatatcgatgcagaggccgataatatgatcaaggcgatgaaggagaggttgaacgcattacagggatagtatttttattatttaacatttacaatatactaagataaattagtacgatcggcgttagagtctacataaacttcagttttgccaaaatctaggatgttcttataatcttccgataacaccagccatggccgtagaaaagcgattctgtttgtcgaatcgctccatgtagagaaatagaggataagtttgaaatctttcaagcgtttgaaggggtagatgaggcgctttcctttgtaagttgatgttttacttgttgctttaactgctcatgtctgaactgttccatcagcatttgcttcagttcctgtttgtttttgacccattcctcagctttccctaaagtgccatcgaccacgttcataacattcccgaccatatctagtgcttcctgggcaagaagtaaggctctcttattggaggagattcttttggagttaggtttttcggaattgatcatccactttgttggtagttttagtaaagattctcgaacctgggacctagcaggttctggtaaagagtttcctgtaaatcttgatacaacagagtaaacttttttcaacgtaccgaccacttccaactggatatcatttgcagcagcatcaatatctaaatcttcttgttctttgtttgtatcatcttgctttcgattacccgcttgctcattaagctgggatgacgcatcaaagaactgctcgtcttcttcttcatcacgatcgtgccccggatgttcagctgatgaagtagtttccctcaccgagcaatggttccgtggtcgtacttcagcatctatcgagctgctgattggtaaaggtgaccgacgtcgtagttgctcctttttcactacatcttgaagagacatcaccctttgcgataattgtttattggctagtttcaataatcctaggcatgtcattagccgcttcttcgattcgattgacatattcaactgatattccttcaagttttccttaatccgtctccgtttcgatccacgttcttttcccgtaacacaaatctctttcccttggaccttaatatgttctatatccaaaccatgaacacaagcatcatcgctgtcatcatcatcgccgttgctttgtgtatccacctcatctatctttcttttcgcagcgccgatccatatcccagaagttttttcgatcttcttcaccagccggtccgcccttctgattaattttggatggttcgtacgtgtctgctcatataaatcaacggcactctgcttcatcttatctagtagtctctcacttttaccactgctctcgctgccactcggtgtaacactgtaatcaccgtttcgcagcttatccaaagcctcgacagctatctcttctgagtctttactcacagtaaacttaatagtagactggttacctctatcctcagacattttccgtaccgttgaattttatctttccttgccttattcgagggtgagtcagcgatgtattatatatgaaaatgcgcctgacctttcttcaaagtcccctgtgtttacgctcgtaaggtctgtttcttatattttcacaaggtctgactccacaaacaacccatatgaattaatcactcaaatgtaacccttaccagaccaaaaaaagtgtaacgtactgatttaaaatgtgtggacaaatctaagcacaaatcgctctggtatccagatatataaacaaataggaccgtgctctttgctatttcctcgtatctcatcttgtgaattaactaatacacttttcacattttcattttttcatttgctttccttttcttacattgttctaaaggatcaacttcggaacttagcatgagaaaaatgtgaaaaattaagaccacacacggatatgtcacagtaggaagaaaatgactaccagtagtcggaattggtggaaaggcagcttaggcagtggtgtgtgagacgtctcacggtgtgaatgatatgcagaaagaagtgtttggattatttgtaaaaccattgagccgatattgcagtttccagcggggctacggtcgctgggatgaattagctgccaagtattattataagagaccggaggtggagagggaaatagctcctgcgaaattgccattgttgactgtgccgaacgtgaaagatgctaggattagatgtggatttcgtggctcagaggttgggaagttgctcgacgttctattgatggatgtttacagcacggataagagttggatggagcaatggttacaaagggacaggagcaaaacgagtttggtacgccatggggatgagtttcgtgttgatagtgttagtgggttggataatactgtgacgtattatttgcccagcccctggctggcggaagctgaatgtgaaattttggaaatcagtgacgaatccaaacagaccctgaatcagggcgctgatcaatgtcatttgtatgtggagaagcagactttcccagagcccatttggcctagttttatggtggtacctagatccggcactgcttctcattttgttgattccacggattcatcatcagtttcatctttacatggacatgaaattgatcctgtagcggcatttgatgtctcattgcaatttgccaaggataaatccttagtgtcgaaatatttggagtgtctagacagcactaatattttaaatatatcaaaacaattgaagattagacttcagggtaaagaacaaatattctgtgacttggaaagagcagtcttgagagagatctttaaggaagacaattcagtggaaaaatacgagaaattgaagaactctaaggcgtcagttaacggtactatagaagagtggtccagagaagcacacaaagagttgcaaacatctatcgaacctctattatctgattttgcttccaaacaactttccctttggaaagtttacacatattccgaatccaaattatcgttgaaattacacgaactttgtaacattacgaatgatcttcaaatggttcaaaatttatcacatatttatggatctttaggcatacctcaggataagctatccattatagaccctgattatgctaggaacaaagtacctgttttacacaaagaaattaataaggcagtttacttgaatttcttacagttgcaattcccactaatagctgtttccattggaggatttgtaacagagttatgtacagcctactcgatgggagcattatcttcgttaggtattgttttaggcctgaaacgtgtaaaggatacctggtattccatgttaaagcaattccaattacagattagggaggaatgcaggataggaattgaaagcaacaaacaactactgttgcataattgggagatttcgtatgccgagagagaagcagacctcaaaggcaaagttgctcttttgaaagaaatagccgacgatctcacgtaattatctatctgacgggaaaagaatctattctttttctctatatagtttggtaattttaactaaatggaaacctggtatatatattcgttatcattgactgtcttgtatctaacccatgggaaagattggtagtttaattgaggttcttcgatcttgaaatactcaacttttaaaccgctcactgcataataagggatttcaaacgacatagcaattaacgcgaacttgtctacatcttctttttggttctcattgccatcatattccgtagtttttccatggtactgatcccaaattctctctagtttggggccagtccttaaaggtggtgggtccatggaatttcgtagctgcacctctaaagcttcatgaatctggcggtcccatatttcaaacatgcatttaagcccataattcttgtttccatgaccacccttcaaattgttaattttccaaattatcgaacccgctgttatgtcgaacacaacatctcctatatcgcttttaaacaggggcggcttttcgaggtcaatattccactttcgaataactgactttatcggaattttaattaaaagctcctttgcactatcctgagctttgaaatgcgtagttatggcagctttcaacaatagcttatcctgggtttcttggttctttctaggtttttgggatagcccgaatgactgtagttttataactggttcatcaagtagcggtctattcaatttataattacaaagctcaaattctccatccggtggaataaacttaataactggagattcttccttgattaaggtatgcaggtctacgcattcatggaattttaaacgtttcatgaagtgtacattcttctgcatcaacttattcaatcctatactcaattgaggcataccagacaaataactccggcatattattgttccgttgattacattatttctgaccacaccttcctcgaaatccataatgaattctaatttctcaattacatcaagaaagaattcgttcttaccgtaatggatacccttaggacgccatgagacagcagatgtcatcgttcgaagaatataactgtttatgaatgtttcatcctggtcacctggtggcagctcatgtttttcagaggctgtattctcggaatcatcgtcgggtttgataacttctacctttatgaaatcatgtataatattatagtttgtaacctgtatgataccataatcggatgattcctcaataacttcgaaaattaaatggaagttatctcgtacattgagcttgttaagcttcatgcccataaatttcctgcataactggtagatttcatctaagtaatgtaacacacttatgggagaaacactattattcacttgcattatcatagcgaaatataggttatcacgagttatcacagcgtaatgccacccattgccttcgaatataggttttgtgcatcccttatgatgtttaaggttattctgtaattgaagtatagcatcatcaaggaaatggatcggtcgtagtgctcttcttattagcggttcatacgtctcatcgagcaaaaggaaacatgatgacattatgacaaggctgatttgaccatcagttgatagttaactcggcactctaaatttacttcaggtctcggttaggtttgcagttactatatatgctagaataaatggctttgaaggtgtttgttcaaagcacttttgataaaatggtgcttcttgtgttttgtttcttctcaatatttttagttaataaagatttcttacatcttggaattctatcaactacgcatagagagatgctggaaaaggtaataaatgccactcttcaagcactgaatagtatagacatgtacaataagatagtaaaacaggtaccagtgctgttgccaccaaaacttctgacacaagaactcagaaaattgcctaaatggagattaatggagaatgaattggttagagattataagttcagagattttgaagagacatggagttttttgaacaaagttgccatgaggtcacacttatggggccatcatcctacaattactactacctacaacagagttcagttcagactcactacgcatgatgtatctggtatttccgatgctgatatcatgatggcttctcggattgaaaaatacatcaaacaaatcgatcccaagaagggcatcctaataggggataaatagaatgtattaaataaataaataatagtgtacttctgttttgcataataccttgcaaatacatgctgtcatgattcattccttgcttagtcttagttatgcctgtacgtttctttcattgctagaaagaagtgacatactgggcaattgcaatcatctcttactgctctccagcttcttctcaagtttttcgaactccgcaagtgcaatcttctcctcaggatccaagatctgaaccacgtcctctacttcttcgatgtaatgctttaacatagcttcaataccatgcttcaaggtatcctcactggacgaacatgacttacatgcaccttgtaacttcaaataaactgtccctgtctccggattccatccacggtactggatatcaccaccgtcgtccataatagcaggtctgatccttgtctgaatcaattcatcgatcatctcgctgatctcttgctcatcttcatcgtattcaaatttaggaatgtccacatcgtacccaacttcggaagactttttcacgtcgaagaaatctggtaaaaacgtgggcttcccactggctaaatgttgtaccaatagatctatcaccgtaggagtcacttggttccaatgaatcagttcatctttatttatagtgacgaaatcatcaccgatcatcattgcttcaacaccaggacattgctggaacactttagatgggaatggagcatgtttcaaaagctcctcatcagtgttcttgatctcaacactctgtgtgcctttctcctgtagcagccccccatctgtggaaacaaatttcaatgcattctcattaggcgttgtaagtgtcttgatatgaatagacctctgccatacgggattcaacaccgttcgatgtacgctcttataaaacttgggaccaaaactaaaccttcctaacatcctcgcagtttacaatccgttgtcttgcaacttctcatcctttctctatatatgcacaaaccacttgttaatcatcttagcataagatgagtgctttgtaatactagaggaaattcctttaattcgaaatctcttgaaaattacgttttttcagataatttatggattgaacattttagagaaatgagaaaataaaaggtcccttttacaagaaatgacccactagatatcgtaacagaacaaaatttaatggaaggcagcaaaatatactgagacggtttccgactgtacaagaacaaggtttttctttccaattgtgtgctatttattcttatccagtggtagcttgtgaattgtggaccctactttatatccgaggctgtgtgattcttaaagagacgaaataaaactaattgccgatcttttcttgagagtctaggaaaaaggagagaataaaggcctataattagcttttgatagacaatacgatgaatttcaaattgaattgggtcactttgttttgtacggccctttggttgcattttgcgacggccaataagggtactatcacagagaagcagaatcaaatctgcagtggtatgtattctaaagaggattggagtggtcgtgtagatccatatatttcgttcgatttaaagaaattgaacaaagaaggcatctctgtggtgatctttgatttccaagattacatccacattggggctaagacgaaagcgggtgtagttaagtatatctgtgacgaagaagcgataaaagagaatctatgtcaagaaaagaacaagaaccagtttatcatttcacctgaagcgtatgatccagatagtgataccgaaaagtcattaagtgccgacattcatacgttctatgtgggaaatacaggtcttgtgaaggacaaatatgccattaagaaaactggttactattgtgttggtacttacgctaaggacactgggatctcttacaaggctgaggtaaatttcaggaatagttttggtaatctagctgcttctgaaattaacaaattgccattgtatgggttattggcaatcttttatgttgtcgctatggccttgtacttatttgccttctggaaacacaagcatgaactattgcccttgcaaaaatatttactggctgcatttgtgtttttaaccattgatacaatcttcatttggggttactatgacttgaagaacactaagggttcgaccgctggtaccactgtttacatggtcattgtttcaatcttgaactctgcaaagatcaccatgtctctattcttacttcttgttatttgcaaaggttacggtgtggtttaccctaaattgaacaagaccacgatgagacgtgttcaatttttctccgtacttacgtttgctatatctgtcgctgcccttattcaaaactatatgactccttcagattcgacatccatggtcccattgtttttctttatcccattaggcatctgtttcatgattttctacttcttgattctacaatccctcgatcaaactgtcaaatacttgaagcaacaaaagcaaatcgttaaattgggcatgtacaaaaaattgataattattttttatgtcgccttattcgttatttttggtggtataattctatcctcttttgttttaatcggtatgagtagtatcgagatggtcgaacaacattggagaactagattcttctttgtggatttctggccatccttggtatattatgccgtattcgttgctctttccttcacatggagacctacatctacttcttatatgttagctgtgtcgcaacaattgccaacagatccagaaaatgttgcagatttcgatctagacgatttgcaatctttggaacaagaatggaaccaagagtacgaacaaccagccggatctgaaccaaatgaagcagacctaaatttctcagatgatgaaaacgataagaaaaagccggtgcaaccatcagcctgaaggaattattttcccaaggctattttatccaaatttatcagggaaacaatgtgccaccaaaaataaattacttttctagatgatcgtcagaagttgccactgaactgataatttattcttcataagggcgtttcttctttatgttgaattcatagtataagtgcgtgtgtatagtcaagcagcgtctaattatattcgtaaataaaaaaatgcaatatgtcaacacatcgatacaaaaatctactccgtttattcttttcagttcttaacgtcacttttaaaaatcaaaattatgaaacatttataaatataaactagaatcatgacattcaagataggatatggcaaagttggagccaactgttctaattgcttgagcctttcaaaaaactgtgccatcactgtgtaaattgatcggtggcccagatgtttttgatctaagttctgcggcaatttctcttccagctttccaggttccagcttctatcaactgtgacaattgtaaattagaacctaatttatcgtttactaatggtaacaagatgtccaagagcccaatggtaagacatctccattctacaattacaccatcatcgggcgtgaatgttgggattgacggatcatatccatacttcttcgaattagtcaatccaatgttcaaatattcttctttcaaagatagtacacccaaatcgtagaacaaccccccgtttctgtactctggtagacctgtttgcaagtccttggaagatatattgaacttgtagccaaattcctctagtggtctcaataatgaataacataaccactgcgtcaatttatgaaatgacacgataatttcatcgttttcggttttatacacccagcaatcgcctaaaggttcaccgttcagagttaatcttccagtaggccatatagaggtatatccagtcattagaacctcccacaactgttgcaaatcaatgttttcagagccatttaatttgtaaaggtgatcaattatattaccaggcctggcatcttcaccgaataactcaggtctttcagaaagggatttccctaaacttctgatcaactgaattctaccttcgtaaccttgcaaagagttcttactacttatctgaaaccctttatcaaaatcttgttgactgaagtctttcaatctagaaccttgtactgtctgagatttatcatgcgataaggcaccatctttgaacatatagaaagaggccaccgctagtccttctgatctgttaatcttagtttctttctcaacaaaagaccattctgaacctgcaccagcatcgacaatcacactaaacgttatcaaatcaatcaaccgtctgcatacctccaaaggatcgatgttctgggcagcccaggaattaatgagagatcccattctatcaataccgttacagtttaaatgttgccatcttccatgaacaggaatatcgcctaggttcttgtaatctctttcaataatattgaccaagtaatctgtcactttcgacattttacccagatccacttcaaaatgtgtactgtcaccattttctgtttgcaaaggggggccgtatactttcttacaagtttccctaacggattgaatggatcttaagtactccaagtcttcgcattctgtgtgtgtcatgataaatagccagtatgttggtttttgacagtttcaacgggagataatatacaatgccatcagaattagtttaagcgaagtatcaactgggatagaactatttcattcactaatgagtgtatttatatacttcgtggatggtacacatacattatccttaattcaatcctaagtgtattggaacgttagtttgcacaaaaaaggcattcttatcttttgcaattgacctgtttcgttattctggcaacgattgatccttaatgttcaagaatctccgtcgcacctccgacggatattaccggggactgctcattctttatacacccgtacatatatgccatgggattctacttttttgatataatcatcctctctttcctaaaacagaatactatatgaaaatttcatgatgttctatgatgtcgacaagctagtgctccgaagttgaaattctaagctctccaagatagatgagcattagcatggtattgttaaggttacttacaattagatattaagtctattcatgtcataagaaaccaataaaactaaaaggtatacacgatgtctcaagttgaaaagaaatctgaacaacaacaagaagttgtgatccacaagatcagaattaacttgacctccactaaggtcaagcaattggaaaacgtttctgccaacatcatcaagaatgctgaaactttcaagttggtcaagaagggtccagtcagattacctactaaggtcttgaagatctccaccagaaagacccctaacggtgaaggttctaagacttgggatacttacgaaatgagaatccacaagagatacatcgacttggaagctccagctcacatcgtcaagagaatcacccaaatcaccattgaacctggtgtggatgtcgaagtcatcatcgctgcctaaacgcaccgataatgatgtattgtcaatatcaaattggcattcaatgaataacgggcaggaaactaaagtgttgaccagatttactgcacatcctttgagttttctaccgacataccttgaattcaaatttttttattttacttttattcgatatccaggtctcaagaaagctcttgtatcctcattctctaagattatagtaagactcctataaagtatggtcaattgtgttcaatataggatggaacctttttctgacacttcaaaaaatgacaacccactctaggtagggtagtttatcgtgtacctctattctactatcagtggttaaaaaataatcatatcctctaccaacatctcactcatatttgtttggttactgtctggtttattggttgcttgaatgagtaacttttttgttgtcatgtgttagtgccctccatcctttgtgtataattcgtacatatttttttaatggaatatgattttaatcatgggacttcaaagcaaggcattcaagctgacaactcgaagcagagacttctgcaaatggcctttcttccacatcactttgtaaccctaattcatgtaagaatttcatgaacgccagtttggatgtgtttttttttttcttttcgaattttttttttttgaagttttctttcaaatgtataagaactcgaacacattgatgcaacttgatacttgacaaagatcgattaaaaataccattcagattaaatgcggatcgtttccatactcgaagcattcggtaatcgaatttaaaccactaagatcaagttacttaggtgcttcagcagaagcatcgtgtacttccgctaggaaagacattgaagatagaggagagggcttctccataattagtttaatgatgagaaaatgtccttagtgacaatgctataaacccagctcttcgatcattagaaatgagaagagatacctgtcaaacgctctgataatcactagtaatacaatggaaaacgaaaacaatgcctttactttattctttatacatgtcggatctttacaaagcttatattcttgcagtatgtacgcctttgagtctattatcttgtgttgctatgggtatagcctctattattttttaccactagtagctttgaagtggattatatcaccgtcttcgaccacatattgtttaccgcctcttttgatcttcccttgagacttcaattgcgactcttgaagcggaggatccatttttttgatatcatcgaattttataatgttagcactgataaatgtcttttctaaatcactatggatagttccagcagcttctggtgccaacgttcctttcctaatggtccattgacgagcctcaattggtccacaggtgtaaaaactgatcaattgcaataactctctcattttgatgataatatttgggagtgctgtcagaggtacttccaacttctctttaccgatgatctctttgcaaaaagcctcaaattcttggagattgttgtccaattcgttgtacttcgtttcaagttcagcactaaacagcatcacttcgtctccaggcgcatattcttggatccaatccttgattttcttcaagaatttgttttcttgcaaaagataatctttgggagcaacgttaagtagaaccagggttggtttagctgttagaaagttgtgtttattcaggattttaatctcttcctctgtccagttctgcttgaagtgtgacaattttcttccctcgtacatatgggcctctaattcctctagcaatctcagttcaagatgcatttctaagaattctggagagtttttcggagatctgtttatctttttgttaattctttctcttgcaccttccagccattcgagatctttcagcaccagttcatcttgcactaatgacaagtctctaactggatccacatttccttcaatatgagtaatttcatcattttcaaatcctcgaaccacttggtatattccgtctacgtgccgaatatcattaaggaacttgtttcccaaaccttccccacttgatgctcctcttgttaatccagcaatatcgaaaatggaaagtgtagctggaattttcttctgactctcatagagtttatgaagatggtccaatttaaagctgggtacaataaccttggactcttcgggttctatagtggcaaaagggtagttagctggattacccaatttcgacttggttattgcctggaaaaacgttgatttacctacattggccaatccaacgatgcctgaagctagattatttgaaggtcgtcccagtacggtataaaaccgttttatagattggtgaattagatgcatgtatgttggcacaaggcaataccttgcattgaggtcagttgattgaaatttaagtattatgaactatttcaagatttgattactcaatgtatcttatattgacagaatctgaaaaaaaaaaacaaatgatgggatgagatgtgaaatcgaacttctacaataagacaatacgaaccaactattgatagtaaaactacagatcatgcaacgagttataatgctctccgagcgtatacgaatgtttgtagtatacgatcttgagttcgggattcttcgcgtcttcatttatcctgtaagtggatcttcctgacatcaaaatgctaatggtactgttaaaaacttttgatagtgccaaaatttctacttctccaccccattgggctgtagtttccatagtttttgtatactcatcaagatcctttacggtcattgtattttcatcgaaaagatatgggatgaaatcgtcacggttctccctaatgaatgatgatgaaagcgatctcaacgaatagacgtccatttcagacacgtacttggtacctgtatattcctctggaaagttataatcatactcaatgtcattattagtctgatggcggagcctcagttgatctagaatactattaaacaaacagtgtccatccggctggatatcgaattgtttcaaatttagcactacacaaactttatccaaagagttttgctcaatatctttcaagttcggctgctcggctgcctcttccattgcctgttgtttaattcttgcaacctctgcatccctttttgccaatcgctccttttgtctattcctacgtttctttccctgtaactctggttctcgctgttgcaactcatcggttttacaaacagattgcacaggatcttgatctaaggacaattgagctaataattgagctggtgtgatttcttccgaatcagaatgctcaaaagcaacaccgttcaactttgcgagctctgatttatgtcgagtatcaagttcctgttctaagtctgtacatttggcatttacttgcttcctcgtcttctttgatgcttgcttcttcaaagaagtaatctgattggtcaaatctttacgttccttgcgatgacgcgcaagcagctcctcttgtgcagtttcagtagacattcacttattcttgagagattgcttcagagaggagttcctttatataacaataaaaattgttagtatgctgaagatgagatgagcctattcatctcacttcttcattttcaggtttttttggttttcagtttcgcagaccagaaagagagatgacggcaggattagctacgaataaaaaaaaaatcaaaaaatagcgccgctcggtttcgatccgaggacatcagggttatgagccctgcgcgcttccactgcgccacggcgctgtcaaagatgaagttttagtttttccaacgaccagatcacatctgcgacaactccaggcagctccggaatcattttcttcgtcccgtgcccccgctgttgaaatgacttaccccacataaagtttcaaaaaaaatgaaaaatccgggagcgtgttagggaattaacgacagaccctgaaggaaagtgagtaaacgcttcaaagagcggcttgaacatgttatattccggtctaccccggagaaagatgtttcacgcgctgaacaggagaaggtcattgtatatattcctacttttttctgttgcctctctactttctggtgctatttgtaagagttttttttgtttttcatctttccgccggattggttaatttccccggagattccatttctccggccttgaaactgccgtacaaaccattggctcctttcgaaaatggtggaatccacttcccgaaaatgaccgagctgacaagaaactgcccaactgaagctcgagggattcgaaccgtttaagcttcactgacgtccgactatctactttgacaaaaaaaataaggaccttcttccatactcttatttgacaccaaacacttacgtagttatggttcgctacagttaacacaggaacatacaattatagcagagatcgtaatatttggaaagtagaaaaatgaacttgtcattgttctgcgctggcagttccgattaccttgggtaattgtgccagtttagttctgttcatctttacatgaagcctttctagatgccttcgtatcctgtcttcttctctgtgtatattctgagtatattatcgtaaccgtatgcgacaaaacgtaattgaactggcaactgactgtagatcagtagtgggaaacgcaatgtactgccggtgctctgattaattcccctcagttactctgtgtcgcctaagaaaatgtccttaagctttttcctttctttcataatctcctatatagtccgggaatcatatagagaaacaggaaaaaaaaaacgaagaaacatcgatgcagtcccacataaaagtccaattttgggccaaaaaaaaagtatgaacagtggaaaacagcacaatcattggaattaatacgatcccaattcaggaattaaagaaggatttgctttgtttctgtgaaatcaggtattctccgtgatttggcccttttccaattacttcctgctccttctctcttcgctattggaattgtacaacttttagttcaagtataatttcagttttatacttattatactaattttttttttcttgggtaacgtttccttccaaactaacagatttcattcaaccttcaacactccaggagtactgggactaagtaattaagcattgaggtgggtacaactcttggattattaaactgaggccaaaatcatatattacgcgaaattctatcactaccaccccataatttcatcctattttctgtcaaaataaaggaatacaattatcaggggaaggaacagtaaacatagatttcggaacaagaaacattagagtacgcttcacaaatcccagagaagaaccattttagctgcagcagaaagggtgtcataagagataccaatacgttttactttgttttcaaactatgctaagcgcattaattcaaaatggaatgtcaaagtctggcgatccaacagatgtggaaaacaatactacaaacggatcgtcaagtaccacggacaatgccaatgatgtcggaagaggtgttaacactgaaaataactccaaattggaaaatgacagctcgaatgcagcgacgataactacatcgaaacaggacccatctgctgtagatgaagcaacgactccgaggtcgatcaatacaggagcttctacagtacctgagcctgataatacaagaagagattctgttagcagcaatgtgtcaacggcgacaacagaatcgagaagaagatctaaggtgagcagagcttgtgaccaatgtcgaaagaagaaaattaaatgtgactttattgaggggcacgatataaacccagatcagagctgcactggttgtcgcaaaattggtgaaaaatgcagtttcgaaagaattccgctgaaaagaggaccgtccaaagggtatactagatcaaatagccaaagcagagaaagacgaggctctcagcgacgcagatcttcttctgaagtctctcagaagggcaagaaaccttctgttagtaatcctgtgaatgcagttaacgaatcaaaatcagaagtggatgcttccttacacccaggtcaatctgctacatcgacgacgaacgtatcattacatccattgttacagtacttaccaggaatgaaccattctgcagtgtctgcttcatctccttcagctttgcaacaacctttttggaaagttccttatcacgagtaccagaaccagcgaaggccatcgcttgattcattggctagtgattcttcacaaaaacccggtggtaaaacaaatcaacaacagccacttccgtcgcaatcacaaccacagtcgttacaaaatatcggtaactcaaggtcaaacactgggccattacctacgcaggacactttccgcaaccagaggtactactatcaaccgtcacaagattcggtgtccgaagcaggctcagataacagaagaggatcatctgccatcccaccactccttaacccggccattcagcttcaacagcagcagtattcttactcacaatttgccatagcgcagcagcagcagcagcagcaacaacaacaacaacaacaacaattgcaattacaacaacatctacaacaacaacatcagttacaacaacagcaatcccttcattcgccccaagccaacactatgaatgctagtacaggtatatcgaatggaggatttgtgccatattcagggaataagggacttccttcaggtggtcacgttctagagagaacggatagtgttgctagtgatgcaatgtcgttaaatgcctccccgaatatttacactgcagaggtagaatcggctccagcgtcacctgttcaaaagaagagaaagagatcaaatagatcaagtacatcaaaaaaagggaaatctacccaacagaacctgcctgctactactcctactttgattaactacggtcagatcgctgatgcccaattaattgacacatactatgcatatatccatttgaggttccctattattcctatcaataaagacactttaactaatgatctattactcgtcaatacccaaccaatttccgaattacatgaattaaacaactacatcttactttggttcagaaattcattggaactacttattcgcatctgtttaaaagacaaagaatcagaagaaatattgtatcaacaatcaacgtttgtcagtgctatcaatgaatgtttccagaaaattgtggatattcatccaaggtttagagacttggaaacccaaattgatgagaaaattgctacgatatatcttgttacattcattatcctcaattgtactttggctttagtcagctataacaactctttcgtccttggaatgtcggtaattattttcaatgaattaaagctctggaaaaattttatcttcggcaattggaatactgttactggtcacgataagatctgtttgcgattgtattttgaattgaatacatttgactctttacaatcttgttctttcggtgtgcccaaattaatgaatttgaagcttgacgaaacgactgcatcaaagctattttatgacgaagtatcaaatgatggtaccggccaggaaacggataaatggaacgttgacgaggatccagaaagaattcgaattatagttgataatatggagttaggctatttcctatcaagactatgccaagccagaagatcgtctttcgagaaacctctacctcttgtcggtgaacataacgaaaataaaactataccaggcctattccgtgcattcctttcaattaaaagacaattcactgacactttacttgacttaccagatgctgaggggaagctaccagaaatgacaccagagcttgtcacgagactaagcaatatgatttgtgatttgaccacaaccattcatgacttactaaaactaaatgtcgaggtcaaccccactaattgtttagagttgttccccgacaattctatgcaaacggtagacgaatcttcggcacacaattcagcagcacaatcatcagatccgtcgaatattgaagttgggaccgtatcaccctacgttatcgcaatatacaaagatctatttaacgttgttgaattgattaagaacatgccaacctcgttaattggatgcgttatgggtacacaggctccaaacttcgattcacagccactagtactacaactatctcaatgcatgaacaacatgctacagataacaacctttactagcagtttgagccctttcaagatatttaaacatgaactgaatgctcaatccaaaaacaaaaccatagatgcagtaccattgtggaaacagaaaatgaaaagttctttagcacctctccaaacggcaataacaccacaagaaataatgatggcccagttcatagacattgcatggtgcattgcagacactgaagaactaggatggtttaatcagtaactgaataaaacaaagttaaataaggaaaggtcaccaagctaagtgaagaaaagaaaagaataataacctaaaaatattctaccaaattcattggcaatcacgaaatttacttcttctccgataatactatcatgttacgaaccgaactactcactaccttcctttctcaaattgtaatactaatagcatcaaaaatgctaacacactcctttagagaatagccatcaccttctgttggaatataatccctaaaactaacacacacttccatatatacatgtttctattatccctatatattttccaaaatgtactttaaagtgttccttgattttactcacaacctacagacgctccctgttcttacaaaaggtttctagtgtcacaactcagaataccttccgcatgtgctttgtcctcctggtcggttgtattcccccccacgggcagcagtattgtgtggggttttgcactaacaccgggtaacattctgtggaaccctaaatctgaatcttcgagattttttggttttcgatttagcttttgaggagggaaaagacaagattctttaaataaggtgacaactcagacctattggatttgtgtttaaagtttggggtaagattcgactggtaaaagtgagcaaataactaaaaattaggtcaattttgttcttttgagtgttagctggtagtgattttcttcgagtgggatcacagcgctttgaacaaaaacttttttggttgtgcggtaagtataattgctgtgtgtttgtttgagattagttttaaggaagaatcatgtcaacagtgaagaagcataccaaaactcattccacatacgcgtttgagagcaacacaaacagtgttgctgcatctcaaatgagaaatgcattgaacaaattggttgattcggtaaatgatgatactgtccgtagcaagtttgagaacgaaatggattcgttcttttccctatttaggagatatttggctgaaaagtctagtggtaatactttggattgggataagatcaaatcccctagcgcggatgaagttgtggattataaggtcgttgaatcatctcaggccgaaaacgtgtccaacttggataaattggcagttttgaagttgaacggtggcttaggtacctcaatgggttgcgtgggtcctaaatcagtgatcgaagttagggatggtaacacttttcttgatttgtccgttcgtcaaattgagtatttgaatagacaatacgactcagatgttccgttgctattgatgaactcattcaataccgatgccgacactgaacacttgatcaagaaatactctgcaaacaggatcagaattagatcttttaaccagtcaaagttccctcgtgttctgagggattctttactacctgtgccacaatctttcaacgatgcattagactcctggtacccacctggccatggtgatttgtttgagtccttgcattcttccggggaattggatgctctattggctcaaggaagggagatcttgtttgtttcaaacggtgataacttgggtgctactgttgatctcaagattttaaaccacatgattgaaactggggctgaatacataatggaattaaccgacaagacaagagcagatgtcaagggtggtactttgatctcatacgatggccaagtgcgtttgctagaagttgcccaggttcctaaggaacatgttgacgaattcaagaacatcagaaaattcaagaacttcaacaccaacaatttatggatcaacctaagagctatcaagagattgattgaatcacaagcattatctatggaaatcatccctaatcaaaagacaattactagaaatggtcacgaaataaatgtcttacaactagaaaccgcatgcggtgctgccatcaggcatttcaagggtgcccatggtgttgttgtcccaagatcaaggttccttcctgtaaagacttgttctgatttattaatggtcaaatctgacttgttcttcctagaacacggtgccttaaagatcgatccaacaaggttcggtgcaaatccattaatcaaactaggttctcatttcaaaaaagtgtccgggtttaactgccatattcctcatattccaaagattatcgaactagatcatctaaccattactggtaatgtttatttgggtaaaaacgtcactcttaagggaactgtgatcattgtttgctctgaaggtcaaagaattgatatccctaatggatctgttttggagaacgttgttattactggtaacttacaaatattagagcactgagctttaatgaacgttaacaaacattaatacttggaattacgtcgcatatcaaagaaaaagacacatgccacacttatgatgaactcgtagcctgagcttcaacaatgcaaagtagttgtttcgctgaattatatataacaagtatttaacactcaaccccgacattaataacaaaactcaaaattctattatctgcactaaggaattggtctttgaacctataacaatgcaccatgttcaaatactttgttctaactgttgatagctcaattcataaattcgtccttttctgaagcgtaggctacgagtaataccgttaagtaattttcttcctcgtacaattcatagtcagcacacttattctttctgtagctaaaacatttaaatacatttttttctaatatcaaatgttaagatcgaaaccctttaaataactgacaatagtcgatcctaggggaagacaacaaccgccagagctactgcgctgaccccaacccccaatatgagtacagataacagtaggattatattttttattataatccttctattcttcctttcttcaccgagtggcgatggtgttacatcacagtatgaatttattcagctagagacattaaagtcgcaactcaaatacgagtatgaagtattccgtgaactatcgtacgaccaaaacttcagaaatataacggggctcaagcttgcgtaccatgactcaaaggaaaatcccaacttgaacgctacctatccacttccacacaaggattactcttcttggaaacctaacgagaattatatgatgttacctcaagatattatagacaaagttcaggataatatatggaacagaaaacaaactttatttcctcccaacattaccagtaatttatatggtaaaatcaatctcacagataacaataaatacaccaagattaagatgcctattgccaattttttcgatcctccagaatccttccaggacgaaaagccagcagatggtgaacattatttggcagttgatgaaaggggtgatgctggcaaccatggagaactacacaatgtttcttggagttatgggatagttgatgtcagtatccaacatttggattctgttgagaactcgttgagtttgtcaccagcttccatttcaacgggggaatcacagcttggagaagatgacagccattggaagattttacatttgaacgtcaacttttacaacagagaggagacagagaagcattcgttatctactaaaggtatctatgacatatggactgggagaattttaataatgtctcaaagtgctaagttccattctcttttcgccttcccccattacttggctaacactgagaaagagttcaatcaagtaaaaagattgatcgaaaagtattggaatgcaactaactatgctgaatcattaaccatggccaatctacagcatctttcagatgaggctaacacgaagtgtgaatatttcgggtttttacaactagaaccatgggatcaatttaccccagaccaaatcagaatgatagatgaagaattgaaatggccattgggcagaccaattaatagatccaatttaccgcctatccgattgcataatgctcttctctattcacctgattgtggcttgtctttggaactagaggatgtccatggaccgagatatgaattgcaggttagaacaatcagaattcatttactattaggtgttttgcttttcttagggcagatatatcttttgttatgtcaaatgaatttcaccaatactccaagttcagtcaacaaaatctcatattggtgcttattcatgatgaatctagtggatggatgcttggctatgttatacttccttgcatctccgctacttcaagagctttatttgcccttgtgtatcagcgcatttgcatgctttattttagcgagtgttttcgaaattcggtatatgatctcggtttacgcttctcaagtcaatgaacaaggtgtgggtattttgacgctacttcgggggggttctgaagcaaataccgttgtaaaccgagtcataccagacgaagcatccatcagcagctcgttatatggtagattttttttcactttgattgtctcgatatttattctactttcctcattaatatggcccaaggaaataagaactatatttgaatatagtgtacttgttgtactcaactcttactgggttccacaaatatgcaggaacgctgttaagggaagcgatccacgtcgccgccgccaaaacggataccaatcactccaaaacggtgataccaattgcatccctttgctttggtctttcattatcggaacatctgtacttagacttattccaatagtctacgtgtttacatacccttccaatgttttccgtcatgatatagatgttcgatttgctgttctactttcactttggatgcttttccaacttctcatcctatattcccaagatctccttggatcgagatggttcctaccacagcatgtgatacctgatggataccattatcacagaccagtaccacaatctattttaatggaatatggttcacaaaacaattgctttgtgtgtccaatttgtatggttgatgttcctgtttacgtagaagagactgaagaaacgcataagattgatgcccagagttacatgataacaccatgttcacacatcttccacaccgaatgtttagagaattggatgagttataagcttcagtgtcctgtttgtagagcacctttaccaccactttagaggccattgccattatgtcgtagcatggacagtgtcacgtttgcagccttttctatacgcagtataatttttaaccttaaattatgaaaatgacattatgattcataacttcaaatactcacttatcttgcacaacaacgaagataggaaaaagcagagaacaagcaccaccagtaattgcaatcatgactattaggcatccacaaaggtatgaatgagtatatcctacttatacaataatttaattccttttaaccgggctgatactaactgatcgtattggatctatatttttagcgtcaaagcatgcctgttcgacatggatggcttgttaataaacaccgaagacatgtacactgttgctataaataaggtcttggaggcacatgacaaaggtactatgtcttgggatctgaagttgcagttgcaaggtttgcctggtccagaagctggccgtaaggttattgaatattatgatttacctttgtcattcgaagaatttgatacgttgaataggaaacatcaggcaatcctgtggccaacgagcaaatttctccctggaacattagagcttattgcttacttaaaggaaaggaacgttccaattgcgctctgcacctcttccactgtagaaaagttccatcataaaacttcccaccttactgaagctttcaaagcattcgacgttataattactggtgacgatcccagaattccaaaaggcagaggtaaaccttttccagatatctggcaactggggttgaaggaattaaatgctaaattcaacacagatattgagagtaacgaatgtctagtctttgaagatggtattcctggggtcaatgctggaaagagttttggcgcatacgtcatctgggtccctcataaagatgcgattgcgctagtcaaagaccacaaaatattaggcgatagaggtgaaatgctagaatctttagaacactttgaccgttccaagtttggattatagttaagtaaaagagagtacatatgtcttaactggatttcagacaaaggcatagttaatactcgaagtacttttttgaatagagagattaaataatgtcttcttataagttactacgaacttagttgacttaccgtcatgggatatatgttacatcgacgccttgttattgcttatagtggaggaatgaaaagagtaaacgttcagtgaacgtgagtcaatcggcaaacaggacagccagttggatgagttaatttaacagtgaatcatcagagagggtagttcttgaacaaatatgaaatactttcaccgttgtgcaaacgacgaatagcttctgcaagcactgaagagatatcaattgcatccaattttggacaacgtagcatcttttcttcgaaaggaacagtatttgtgcaaactactctatcaagttttgagtggttaatgttttcaatagctttgccagatagaatgccgtgggtaacgatagcaatgacggacttggctttgttttccaacagaacttctgcagccttagccaaagtaccacatgtatcagccatatcatcaacaatgatacaaatcttgtctgagacgtcaccaacaaggaccattcttgaaacttcattagcgcgagctctttccttatgaatcaaggcaaagttcaaatccaaacggtcggccaaaccagcggcacgtttggcaccaccagcatccggggagataatgatagcttctttgaagttaacattttccttaatatatcttacaactgaaggctcagcatataagttatctactggaacatcaaagaacccttgtatttgagaagcgtgcaagtccatggtgatgacatggtcacaaccagcagtggtcagcatgtcagccatcaacttagcagtaattggagcacgagacttatcctttctatcctgtctagcgtatgggaaatttggaataatagctgtaattcttctagcagacgcggtctttgatgcattaatcattattaatagctcaaggacacgatcattcacatcaccagatccgatctgtgtaacaatgaagatatcttggtctctaacagattcaccaatggaaaaagatacttcgccgctgggatccctcttcaacttacaatttgtaagcttcaaacctaacctcttagcaactaactcggctaggttacgatgcacatcgggagccaaaagcttgatagaattggttgccattttcttatcagtattgaaaagtgtttaaatgatgtgtttgttataacagtttgcttatttttcttcacaaaactgaagtacgagggggtatgtgaatcgaatcaggagcacaaacgaagcagattacctagttcaagccaaaaccaaacctgcctatttcctcccaacttcaaacatcttcatcttaagtcttttcatcaaaaaacctttctttggcatccggaacttcttttagatgaggaaaaaattttcctttctttttcatgattggaagagaaagactctttggttggctaaggaagactcagtttcattgtggaaatattgccggtataaatggcgtaggaagtcgagattttgacatgcaagaatcaattattgaactttaaatattctatctagaaagctgcacatacaaggcctaattgtagtaatttgcttatcatattttgggtattttcggaatcttcttcttctttttcttcttgttcttagcactggaagatgcttcggaacctggaggaggttgaagcactaacgttgcattttgaagctctgaatcctctgcaaacttttcctgggattcaaaatggaacatcaagtcttgaatttgtgactgcaattcttgattttcatcctgtagtttctgtttctctaggctaaatttttccatctgtttagttaaatgatctaagttttgttgaagtccggagttgagcagcatttcttccttaagccgatttttcatttcttgcatactttcttcaacgagtttctttaactgtttgtgatcatctttttgtctactgacttgcatatcagactcgagcgatttcactctttcatgcatattgtaaatttgtccctcgtaatactcacgctgagattctaactgagacaaaagtacttgaacgtattccaaatgatactctttattccttttcgtattactcccgtcatgagattcacccacctccaccaactttccgtcgatctcattttgaacaatccgatggacgtaattatcccccgcataatcccatacccgttttgttgtcaaatccattgcaaaacaatggttcgattgttcgtaatggcatattgcatgttgagaattataacgaccacatccaagatgtccacaaattagacagatccaaagattgttcgtttcaccgcattctagacaacgcggcagtggttcattattaacatcttttaactgtgagtatctgcagacagggcaattaccgtttttccattgatctaggcacttacaatggaacgtatgttgacaaggggttgtgactaatccagtaacttcgctgtctaatttttctaggcaaacaggacacataggtagttctattaaaccatcagattgttctgaactactctgagtaaacggatattttaacatgtaggggagagcatctttatcttcactaaacattccttgatgaaatataagctccttaattgctaccacatgacatgtttctggatcaatttcattgaacttcttcccatcgaagagcttctgaaactctttcgccaagctttgttccttaaatttcatcaaaagcataaaccgtcctttttccttgttcatttttattaattgtaaatgcgtcacttgattggttgtttcttctccaataaaccatcccaatagtctgtttatggtcaagtagtttggaataaatagtatggctagcatccttccatcacctaattcccggtagagttctttatcatcaaaggtaccaactgatgcgtggccattcttgaaaagccgtataataccatggccacaccattcggattcgatggaaactttgttactacaagaatgtaaacttagcattggaatatggttccaactctgttcaatacgagaatcagtcttccgctcaaaagtcaatttgccagacttaaaaaacttataacaatcgtctagactttctgttacctcgataagtaatgtatattccatatggattattcttagacccgacaggtaactagtaggcaaaatgtaaagttttctggttgtacgaaggttcgcctcttggcgtcatattagctgttgccagtagtcatctcatccctaggaatatcaacaatcgggatgagaacctgccaaaggaagaatggaaaaaaaaacgatcacgtgattttaatgatatacttaagccttctcaatgaaatgcatcttttacgcgatgatctgccttattctcgaaatatatgttaaacataacgagttaccgtcacagctttttgacatagcataaaaatatatcatcagaagccgcttgagatactactatgtttacacaaggtcagcatgttcggtcagaacatgcaggaactaaagatgaagcctttggaaagataaaaccaatctgtgtgagactctcccaagttaccttcaggaaagatgagctactcatattacaggatccgcagttaaaacagttactacaagatttgattcaaaacttagatatccttataactaagcacaaatcgctttcagggaggtttggagactatgtgtttgtgcctatctctgcaatgttgaaaacgtgtaaatcacttccggacccaattgcaacattagtattcgaaattttggcgagaataatagacgtttcgtggagtttaccggcgacagtggatcggaacacattctcgcagcttctttccctatcaacctttctaatatctaccgatctagaaaatgtcaaccttcccaataaaccagacgaattcaagattgcttccatcagacttttaagagttttgtattccacagcagctttcaaggaatgggatgcaaatatgctcccagcaattgcacactcaatcaccattttgttaacattattagaaaatagcaatatgtcaatccagttagagagctcaaaaacactaagattactgtacagagtaataaatgacggagaaatgttaagtaatgtggttcccggaaatgtctctacatttgctaagattctctctcgtccagggttgactactcatgtgaaagtggcaagtgatgtattatcgactatgtcagaactattgtgtatggtatatggtgactcttctttggaaactttcatcaaaacgtctacaggaaatactgctgttgaagtaaaaaatccaggaaagcacagaactaccaaatggttaaatgccacatcaattcaattgaaacgcgcacttgaacccaccttttcaaagctcactaaaaggaataatgaaaaactgaatggtgaactatttgaagcttgtgttctactacttaataaatgccataattcactttatgggtgcagagaagttatactaaagacggctcttacagtagcaagggataacgtctttgcattagaaagattcaagaacgatattgcagcattcatgagagataacaatattcaggtcgaaacaaacttcgaagaaatcaaccaatataatattgtgaataatgcattaagaattttggatacagatcagcttgaggaatatcaaatatcaaaaactgttgcttatggaatatatgactctttgaaaacccatttgttgagtttagacaaaacagagaacattaatttaattaaggttaccagttcagaggtaaactacttggtaacatcgggatctcttaataattctgaagtttccataattccgaaaatatcatctacagcgtacgaaaatgttacaaatattttactgcaactaggatccaagatgagcgcctcttcaatacaagaacaaatcattgagtttctttcaatagaatcagatgtcttaaaaaactcaaacgaagctctttggatagcttcaactttattaacagggtataaaaacactgacataagtgattttcttgcgcatgattcagacccaatctcctgccaatatgacattatagaaatggcaaatgagcgggtatcaattttatcgaatcaaacggaactaaacgagttgcagcgcaccaatttgactatgaatttgtttgctatgaaacaaatgattattctaatgggtaaagatttcaaagatgaaatgttagattacatctataatgtcattgaatgtttcgcaagcgatgatgagaacacaagattcatttcgggaaatattcttcaatatttggccaatgaattctaccagggtgcaatgctaaatttgtttcaagataatgttaattacataattgacggaatctcagttagacttgacaattgtctattccatcgtgcatatatggttcttcgtgtagtgataaaggtttctggatacgatcttgtggaacgtttgaatgatatcctagagaagctattttggatgttaggatattatcatggatacgatgacctctgcactgtactattgaacttattcatagagatttcatacaagatacaatacactttcttgagcaaatcgagcggacaatctatcgagatcaaaacctggaaccaggattccttcaagccatggggtatgtctaatatcgaacaagtattaaatgtattggatcaggagaaaactgctgcagatgattatggtagcattgctgaggtagaaccacctgaacagacggccgaggagtttttcaaggaaaggtttgaaaaggatagcgatgacgaagatgaagacgaagaagatgctgtatcggagaacaattcctcggtgaataatggggaggcgaaagatgagatgaaatgggagtccccaatatcaagggatgcctatatgttacttttaaggttttggacgtacgcagacaggctcttaacacattcatcgcgttccgtgagaaataaatgcttagatctacttctcttactatgtcccatgctctctacacagcaggcggtctttttaccaaacgttgccaaagtctgggatatcgttgtacggtcagccatctccgaggatctcgcacaagttggtagaagttacgaacttttaaactctttggttttacacactgattccttcctcatgaaaagggtactagatatgtggaaactcttttctgcaagggacaccatggtatccaaaatgctttctccaatttccaaatctactagagtccacacaacgaacactttgcaactacaagcataccttcgttgcagcaaattgcttataacgtgtatgaaccaattcgggctacaattaccggaccatataaccatagagatgtgcaagtgtttacaatcattacccaaagacaacaacagttgcagccccactcaaattgaatcgaagcacgtgaccaacattcttctcttactaaatctaagatcacaatgagcggtaagcccgttagaaataaattacccggatttgtactgtcatttggacctttatttttgacacacgaagaggcaggaagaaaacaggacaaaccggactgcggaaaataccgaaaaaggaaacagccggctttgtattgatttttaatttcttctctcatctccgcagctttttctgcctggacggccatgattataaactcactcggcaaggaaggtttctcaccgtgctcctcattcaccccaccatgaactgagggacacacgcatcaactgagtctgttatgagactgtagttcggttccatttattatcggaatctgatagcttcgagctgctttaaaagatatacgtttatatatatacatatatgatctatctttttatgatcgttcatctggcaaggaaataggtggagtacggataggaacaattcaagaattgatgaattaaacttgagagtaaaatactttgaactaagctagtgttaatctcaatatagttgatatacgctaccatcgtcgaggcacctcagcattgcatttaccgagtcatttatcattgctattcagtttttcatattccaattctgtctactttcccttgaatttgtgtctcatttagacttttctcccaaatttcatctcatcgcttagtgttaccattacattatcggacaggtttttgttctttccacaataatataagaacattttccaatattaaggtcaatataagtagtgcagcttagaggttttatactgaggtaggtcttgcgcgctcgaaaggcattattttttctgaccataaccgtaagaggcagcttgtgtactcaaatcctatattgtcactgttgaagtgcacatttaacgaccatggttgatgattcgtactatatcactccgcatgagacagctctcgctgttgttgcgacttctatgaagaaggcaagactccgatttgatactttggtgataaactcattgatgggtggaatactcttcagtgcaggtggcatgcttttcgtcgcagcgcgatccgagaatccgttaattttcgaacaacatccaggaatgacaaacttcttaggagccttcactttctctattggtctcttttacgttatcatcaacggtgctgatcttttcaactctaacgtcttgttctttactgtgggttttctacgtggagctgtatccatatatgatcttttcgttagttgggcaataagttggttggggaacattgccgggactttatttgtatgctacgtcatctgccatctatctggcactactacctccgaactacttgtcgccggatcaatatccattgcagaaggcaaagctagctcaagtttcattcaaacattcattaagggtatcgctggtaatttttacgtttgcttggccgtttatttacaacttatgtgcaaaccaatccatgttaaactaattgtcatgaccataccaacattcacttttgtcgctttgggattcactcatgtggttgcagatatgtcgatgctcatgattggtatgcttaacggtgcaaatgtgtcagtcggtacttatatttggaaattactcatcccagcaaccttaggaaacattataggtgggtccttctttagtggagtgattccatattacctacacttacgtgttgtggaacgcgataggaaacaactatccttacctgaatttgaggctagagatgagcaacctgagttgaatatggactcaagagtcgttagggtggatcctaaggagacagcagaggctgaagatgactcagatatagattcagatgatgaaaactacggcttactgtccgagaaacaatcttcagatagtacaggacgtaacgcctctgatgatcaggtactcccatacgttggtactgatggtacttccagagatcttcatagaagtgagactaatggtacaatggcatcacttcggtcacatggctctaaaatacgttctccacctggtgttttcccagtaagaggaatgggtaaaccattggcaaaagaaagaagtatagttgattcagaatactccaacgaatcgcatcactcttcaaaggcttcaccgtctgtaaattcttttgatatgatatccatgcgtagtgatgaggattctactttggaaaatcctatcggattccaaggtgtatcgcaacaaccgtctttacaagaacggagaaattctattctacgtacgttatctcgtattcctactgttcactctaatcccttgcaccatatgagttctcaagatgaccaagagtataagaaagaagtggaagaatatgaaaaggaaggtcattacaatgtaagagaccataagctaggtactaaactagaaaaagcactaacaagaatcgccacccggaaatccaatgaagagctatcggatatgctcccaagaacgacgcaagatattttcccggaacaaaaacctgccgatgaaatgaatccaataaactcaagaaggagtgggactaccatgtccggattactcaaaacgatcagtaaacagttcgttccaacaaagcagccagccgatgtaaatgaggttcacagaagactcagtcaagctggcatcaccaccaaggctgccaatgcatcagacaatattgcggggatcgaaaattatgatggaattgaactaccctcacattctccctactacagaagaccctctaatataagcaatgattcgacttcaaattcactctatactatgggctctgttaacagaagcaagacgccgtcctttatagttgatatgggtcatgcatccaacccaatcggcggaggaggtgtatctgttgcaggaaaaagaaaatcataccctctgaaaaccatacctcattttgataatgacaattttgaggaacaaagtgtgacagacttgcattagacgctatgaagaaaggaaagctttctctccaaaatgcgcacgtaatgtcagactagcatatttatttactttcaatgacagactttacaacattctttcccagctcttcgatattcataaaaacaaatacaaggacaagcaaccgcaccgctgtttttctaaacgaacagcatcaccatcagcataatatgtcattaagttaactgtttgaatcgtaaataaccgcatatatatgtatatatatgtcattctaacgacctgataatgattgattttactataactgtgcattcctttaatgttacccggggtacgcgtgatctccatgtttttaagatagaagaattatagaacatgaaatacgttaacgcgttgaaatgactttgaaacaagatacaacattaacagcagggcgtgacgagataatattacattcccgttgatatggatagatcgaacagaactgatttacatttctctctttactgaacactataaaggatgcagtcgttagaattcaataaatcaatcataccaagtctggaggactcattctcttctgccgtgcaaatcgaaagactaggtgagcttcatgaggagttggcaggattagaacaagggaaagtagaattgaacagtcttgagaaatacaagaatgcactaattaataagaagttgctgagacataaagattctgggattagagcattaactgcttgttgtcttagtgatatcatgagacttaacgcaccagatgccccttttactgaaacagagctttgcgacatcttcagattgtttctatcacaatttaggctgcttagagatcctgataacggaaattttatacagcaaacctacttgattactaggctcctcgaatgtagatcaattgtcttaattacagatcttcctccttctaaaaggctagtggaggagctctttgaagtattctatgaaaaagttgaaagtcagttcccctctaaactatggaaaattataggcggtttgctaacagaagtcgtttctgaatgtgataccttatcaatggacgttttaaggctaatcttcaatgcatttttaacacatgagtcaagagcaaataacactttaaaaggtttagtggtggacaaagatccatccttcgaattttctttgataatatgtgaatctgctacaaatagacttggaagacatttttcaaaattttactctgagattctgtatggaattaccaatgagaacgaagggattcactctgttcttgattcctcttaccgaactttaacgaaactccacaaattgacttcttacatttggcagtatacaccagagttagtacattcagtaatcggatttgtgtatcaggaactttgctctgataacgtgccattgagattagctgcaactcagttgataactgacattctttcgtttcactccactctaaattttgtcaccacccatgcagacacttttcaaatttggctatccaagatggcagatataagcccaaaagtacgtgtacaatgggcgaagtgtgttccgaaaatcatagaaactcgatccgacatctgtgaagagatcgctaagggaatatcgaaaactttcattgatactgacgaaacagttcgtttacaatctataagatctttagcggcactttcagcgaaattagtgtgggccagattacaagttgacacaattttcaaagaacttcttcatttaattagagacaaatcgaaagaagtaagggcggaatgtatttcctacgtatgccatttttacgatgaaaccttaaaagaaaatctttacgggaaacatcaacaggaaagaaatgctaaacaactctgggacgttgttaatgagatccctactagcatttttaatttgtactatatcaatgatctgaatatcaatatgcaagtggatttggtaatcttcaacaaagttttgaatttggaccttgaagaagatgctaaatacaacagattgatacaagtggtgtcttctttaagtttgaaggctctttcatcttttttcgcctttaacaaacgtcaagtacaaatcaataaggcaatgaattcactttttgaattgaagaatgaaaaactcgataaacttatcgaatggttagctgctactgttccgaagcagctcgaaccagtggcaatcactcagaagttccttgaactaaatgattcaaggataaatcatctaatcaaagtatcaattaatcaggagacggactgtattacactcaaaaactctttgcatgaattaaagataaaattagaagatccggaactatttcgaaagaagggcgtacgttttggcactatcttcagcagagagtctttcaacaaagtgattttgcttctcgtctatagggccgcaccattaatatacaatgtatcgtgtatcccctaccttcttaacaattataagagggaccaaaacagcacccttaataacgttatgactcagttgattcaaaatatatctgagatcaatccctttttattcaaaagccaaacagcatcattaagctccttggttatacaagacaaggatcgatcaaatattggaaagcatgaacaattgaaaactttatacaaaattttcaaagcttttcctagtgaagtaaatcttgaggatggatacctgctagagaaattacagaattttgcaacatcaggcaatatcgctgaaagcaagtatgctgttaaaataatagcactaattcctgatagcgaaaaaagacggaaactgttatcattcttacggagttcagcgttgccactagaattttcaagcgaatcacctcacttactctgcaataatttatgtattctatctcagctgttcaaagttgatttcgatctactcaagattgattgcaatgagataactacatttatcctcaaggatgtgctagtaactaatgagttcttcaataatctcgttgaagaagaaaaatcatcggactggattactgatgatgatctattgaatgaacaacactggcctatcacagccaaaattttatgtttggaagtattaacaaacagaatgttatcggaagcaagatcagttgataccgacagttcgcttgagacagtctttcataaaatattaaaactctttttgtatttcgtctccaatggcggagaagttatcaatgaagagaatgaaaagaggttcccaactccgttcgcgtatcagcgtagaattcggtgccatgcaggtttacagattctgaaactagccaaaattgctaaattcaacaaatggattgaatcaaaatatatattcaaacttattaatttagttgaagatgaaagcttccctgttagacgcgaattcgtgaccaagctgaaaaactatatttcaaacgaagaaataagcatcaaattcattccattagtgttctttatgccgtttgagccagatgccaaatttaaaactgatactaaaatatggattaattttacttttcaaaaggaaacagcacgaagaggagctatatttgaaagaagccttccaagacttctccactgcattgcgcaccatcctgatatcgaagaaaacctttatgtggatgcttcagaagacgaattcattacatcttgcagcactgcaattgattatgttcttttctttttagatactgttttaaagcccgaaagtatcagcttattgtattacctagccggtcgtataaaacagtacaaagacttgttagatgaggctccaacatgcatttacgtgataagtgaattggttcagatgattttgaatgaattgaaacaaataaaaaatttgaatctcaccgtgtaccctggtaaactcaacctaccgagtgatctttacgtacccttcgagaacatggaattagcacaggcaaatacattcaaaacattcatcaaagatgattacactcaagttcttgagcaaaagataaagctaaaatgtagtaaaatggtgcatgggtcatcgacgacaactaagcagcaaaaacagcagagaaagttgacaagtgagtataaacagcgcaccccttcaaagaaaagaagacattatagcagtgacagcggcgatgactcagatggtgcacatgatagaagtatttaccccagcccactgaaaagtaatagaggtccccaaaggaaaagcacccgtactaaaactgccgtcgattataatgaagatgatgagaacgaagaggtaatgtaagttacgaaattccatcattacctagctatatatctgtcataatttatctaaggaaatgttttttatcatatgtagttgtttctatatataagtcttcaactcgccgatgaagatgaaacataaaataacaaacagctccattgaatacgggcatgcgtgaacctttaactattgagtaagtttgaaaaattcaagaacttcttttttcggtttcgactctaaaagcgttttcaacttttgaagaatcgttaactcggactcatctatgggttgaatttttgccttttccttcagcaattgttgttccgatattttacagagttccttaaagtcccataatcttttgagggtaccggacgtttggaagtataagaggttggatatatcattcaatatcggggtttgattttctgctgcaactaatttgtctaaaatcgtagaatgctgacacaagtcttcaaactgctgtacacgtttcgcctgataaaccttatctaaaaactctagtgcgacattctgttctgtaagttttgataaagtccaggagtccgcatctattgctatttctgtatctccgttgtttctacttcctattggaagtactatatatttctgttttccccttgctaaacgtcttttgtatgattttggtaatggggcatgcaacgggcatttccacttcgatcccaggtttttcaaggatgctctaggcagtggaagacaatctaagtgccatggtgttgaacagtaatcgcaagtcattatcagtcgttgggagtccggatggtcccatgttcccatctttgattctccacaattatagcacactaaaagttctccagaatcctggttgaaatgatactctggctgataagaatccatccgtgtgacagactgcccgtacgcggaatgaaaaatttgtttttcattgatattttctttaaagtgttcgtcacgatattctccttgcgaccccgaggagaccgaatcgaacgttgatttgataatagacggcaattgaaattggaacggatttttcctttgaagatcaaatgttagagtaccgaataactgatacccgggttgcttgaaatggtcttgtaaaaaccttgttttcaactttttttcagaggacagtccgtatttattagacttgatccattgcttgaatcggcattcatcacaagaccaatcaccttctggtagatggcttggatccaaaggtgggttacagcaagcaaaatggaaagattttggacaagtgtcacagcataagaacaccccaggaccatgacagttggaacaaaaatcgtcattttccttgttattatccggatcaatttctggaatatgtaaatgagaagctttatcattttgtccaaataacttggtatctttatccttggtagatttcaaccttttcgccatttttagtgctatcgatttactgggcgaatttcgtataggatcctgtagcataaaatccgagtcagcctcttgtttaattcctgaatttttgttgtgtttagtgggagtgttcgctcctatgcgttcatgactttgtacggtcaattcatttgatttttcagtttgtagttgtccctcatatttagcctccatgctgctctttaatgcctgtaatatattggatttcttcttcttattgttaccatttctgtgtttaccacttctattattgctatcatcattgtcgttattattgatgttattggtactattattattgttactgttgttgttactcgatcccttcggcttctgagataatggcgtccctgtcatagcatttattggatcatgcactggcggctcctgaaacgttatatttccattactatccttaagaatgactggtccaataggttctgtcgatggttcttgggacggtgatgaagatattgaggatgtacttttcgttggataatcatcacttggaataatccgtctctttttcagattataatccacattggcagtacctgaccgtttgggcctcgttacctccatattttttgtcatgaagccggaaagtagatgtactggcacgtaatttttttagccggtactttcccctactcgttgtttcgcgttgaaccataatttaattcaattgttagatgcgttcaattaaatttgtatcgcacttttttattttttttctgtattccaatatcacgaaccttcgatagttgaagtcgtatacacataccagctatatcaatgataatggaatcaaaatgtatatagttacgggaacaggctgaggcgtcaccagtcacattaaaataatagaagcaaccatggacgacgaattgagagccattagagaggccagattgagggaattgaagcaacaaagtggaggaacatcagaatcagcaaacaacggatcgaatgatggtcaaacacaagcgatattgaatcagattttggattccaatgcacaagaaagattgagcagggtagcgttggtgcggccagaacgtgtaaaggcagtagaagcttatttactacaaatggtgcggtccggtgctattagaaacaaattaacagagcaggacatcgttggaatcctcgaatcagtcggaagagatgagcaaaagcgcaatactacacgtattatattcgatagaagagaaaaaggaacagcatcatctagtgtggatcaagatgacgatgaagacgatgatttctttgactagttatctgtcttcaatatatcaggttttaacagagaaagaaagtaagatatacatgcatatataattacaacgaatgagaactcaatcctcataagtaccaaataattgcaagaatcggtagttccaaaggttcaatgactactataggtcaatgctccctctgtcaaatcaatacatgtccaaatcacgtgcatgtgaccgggtaacgtatatttcctcatatttctgaaaattttcagtatagcaactattcgtcaggaattgcagttcactaaaatttaactaatagcagttaaatgcgttgacaactagactgttgtttgatctgtaaatatttattgacgtagtttatcgtagtgattagtcttctattcatagccacaggaataccactcctacaataacaacatataaaaatcatcttctaagaaatgttcggtctaggcggtcaacctcaattatcttctcaacaaaagctatcagcagctgaagctgaactagatttggttactgacatgttcaacaagttggtcgacaactgtcacaagaaatgtattgaacaaatttataacgatggtcaactaaacaagaacgaatctacttgtatcgacagatgtgttgccaagtactttgaaactaacgttaaggttggtgaaaacatgcaacagctaggccaagctttctctccaggtaaattctaaacccgatgagggaagcttaagccgggacgttagtgcataatctttttcgcaacttttcacgttttatcatgtacatatatgacaaattttgtatatacaaatatattatatatatatattaattatctatttacagagttttaaaaatgaggtaatgtcggagtaccaaacgattaggtttgtgtatctcgatcaaaccgataaatatagagatataaatgtatttgctaataccgtgatgtgtttttgtccattatcttcccttaggattgaaaatttggacgatcccttctgtctttaaaatcctagcattttcataacgcgtaatttacaaccttcaaaagtattcacttttggtctaacgtccaaatatattggaggaaggtggttcttttcaggttctggattcgaatagaagtcgatgacataatctatttgtttcccgcagcgatcgacgacccaatcgtgcctatcaaaaggtttggtcattccaaggattgaggatctaaaccatgctcttggggttaacttctttgaatcgcctttgaaactagtcaatttgatgccaccacagacatctcccccttgtccgtcttcccaaattttgatataattccatactctttcattaacggaattgtggatgggaacaacggctttcatatccacagcttcgggatcccaattttttctcttcattgcctcgaagaattgcttctctgatggataaacccaattatccgatgttccggttctaggaatggaggatttctctctctctgttggcaaattaacagctgtggtatatttcgggtgttcaggtatctcatcacttgaacattcgacatcctcagtgatgatcgatatgattggtgctggtgctgctgcaactgcagcaccgccagcagagccattaacggtctgtagatggtttttcagccatacatcctgggaagaatggtctaccggacaaactcctgacccttcagaactagccggtggatgatttggaggtagtgcttttgctgattcattcttattattagtgctctgttgtttcaaccacacttccttcgtggagtcatccacaggacacttaggctgttctggcattcttttgcactccacagttagcttctaaacagtcgcgaatcccctttaagccgccaacgatgttgcttctatatttcgaactattgcgttcaagcctatcctgatgaaatgcgcatgaataagctttcctgtattcgcatgttctgcatacttttccatttcattcatttcttttcaattgatatcaaattgatgaagtttcagaatgaaattgatatccacgggagatgacatttcattacccgaatgtgcgacaaacatccttgtttctcacgtgacttgacctccagatggagacagctctccgttgtacatagcaatcgatcttgcagccaccgttaacatattgtggtgcagtaattacctgcagagcgacttcaacctaaatctgaaacagggacgttgctaggaatgttttttaaaaggaagcaaacccttaaacagtgtcaagtgcttgtttgttttttacttgcttgttttattttccaattgagcttgattttagttgtcgtctctgtgagatttctagggtatctgagttgaggttcttgactcaaagcttcatcatgttttgaggttcctatgataaaggctatgcaatgctaaatcaggaatgtaaagtaaatattgctacgttaccttttaatattaacatatatatagacggattggccacatcgtgccaactacggcgaaaacgtgaactataaaggaaaatgaaacaaatgaaagaaactgacgctggccggcaagaaattaagcattatgggttgcgtcgcaagtacaggaaactatgagaacgaggatgatcccttcattcaaaataaaagggcaaatgatctcattgagcaaaatttacagcaggaaaggaataagaataagaatgaggtgaagctccttctattaggagcaggagaaagcggtaaatcaacagtgttgaaacaaatgaaactcctacaccaaggcggatttacccatagagaacgaatgcaatatggacaagtcatctgggcagatgcaattgagtcgatgagaacgctaatcttacaagcaggcaagttgggcatcgaattggatagtgatttgaaaaatgcacattcggggcaattggtgaatacggaattacaccaatgcaaagagaagatcttccgtgctaacacattggaccagattgatgccagaatggcgggtggttcagagttcctaaacgagtatgtgttgaaatataatggcataggatctaagaagaagaggcaaaccacgcttggattcaaggaatcaaatggtgctgatcctgaagaagaggatgagacagacgctttcttgagtgaaaaattagccgggacaagttatactggttcctcggagacttcagagttgaaacgtatagaccaaagtaccaacgaagaaattgcctatgcaatcaaaaagctttggacgcaggacaaggggatcagacaatgtttcaataggtcaagtgaatttcaattggaaggatctgcatcgtattattttgataacattgaaaaattcgctcgagttgattatgtttgtgatgacatggacattttgaaaggaagaattaagaccactgggatcaccgaaaacagtttcaagattggaccaagcacgttcaaagtttacgatgctgggggacaacgaagcgagagaagaaaatggatccattgtttcgaaggtattactgctgtggtatttgtaatagcaattagtgaatatgatcaaatgttattcgaagatgaaagggtgaaccgtatgcacgaatcgatagtattattagatacactattgaattctagatggtttgccaacacacctttcatactattcttaaacaaagtagatattttccaagaaaaggtgaagagatctccaatcagaacatggttccccaattatccagggaaactgggtgatagcgagactggactgaaatatttcgaatcattattcttaagcttgaacagaagtaacaagcccatctacgtacatcgaacttgtgcaaccgatacacaatcaatgagattcgttctaggtgccgtgacagatttagtaattcaacaaaacctaaaaaagagcggcatcttataaatcctttaggtgtaatatgtcaggtaacgcgcacacattacatataagttgtacatagttaagcgatgaataaggttctagatcttttagagggtaacctcaaatatttgtcagaccccatcacaaaggccaggttaaaagtgaaaaggcaaaaaaacagggtgtttccgggtaacgaaagatagcaagcaagtctactatttaagaacttcaacaagacacataagtacccttgcttgacgaagttctactgtactgacaatatatagatacttgcaggatataaccgttaatcaagagccataaaaaaacatacacacccaacataccattacagagaatgtctatgcagacgagtttgtgcaaggaaaagaacatcccattgagccagatcatacggcccattcagccggtcctagaccatgcaaagatcgatgcgatgatatctactttcaagggaacaccgaaggcgtctcgaacaatgaccgagtcacaagctgcagaacgtgttgccacattacccgccgatcagcgtctacctccagtggacgtcgctgccgtccgttacccggaaacaggagaaacaaggtactttgcattcggcggctgccatcgtctccaggcgtacgacaaattagcctcggaatcccaggaaaacgatatcgcggtccgttgtcggttgatgcccatgacaccaaaacaattgaaactatacgttggaggatctggagacgcatagtaaatcaaataagagagaattttcagattattccgttctattacccggtggacctgataacaccggttaatgcgtgtcatctggtttcctatgtaacgtatacatgtatgtaccccgggtaacatttctccatacaaaaaattacttcatcacagtgtcggctccgcgccacgttaacaagggaaacatatttctttggtcttcctgaacaagcgtggaacaataattacagctgagatacctccgcaccaaagcaagacaacatggctcaaatacaaaaaaaatgtttgcacaaaatggaaaattacctcggtcaagaatgatttgaacagaaaatttaggattcgatctggttttttgttttggttgaaaaaaatgtcggtcacgccttttagcaaagggaaaagacgtcaatagaagaagctatagaagggagagaaaccaaaaaaaaaaaaaaaaactctggaaaaccagaaaacttcacagtagttttgagagtactgcgttaataaagtatcaaaaataaacgggtaaatatcatgactttgaccgtgataaggaaaaaaaaaaaaagtgcggttgttgttttctgcatggttgaaatgacattaattgcccaaagtaaatgacatgacaatgaaatgtcatgtaatttgtttcgcatatatgttacattttgtatcaatttcttcaatcttgtattattatatataagagagaggtatgtgttgaataagaaggaagttttcttcgtttaagtgtctgactatttcgaatacccctttacatagttggcggtttgcttagtaagaggatcttaaacttttttcttagtctttgttttttattacagaatagtcaagtgctttcaattagtaacccagctccataatacccacacacatatcaccatgcttagaagcatcgctcgtcgtcaattttcatccaccgcattcaatccatacaaagttaccgttttaggtgctggtggtggtattggtcaacctttgtctttactattgaagttgaaccacaaggtcactgatttgagactatatgatttgaagggcgctaagggtgttgccgctgatttgtcccacattccaaccaattctaccgtgactggtttcactccagaatctaaggaatcccaagctgaactagcagctgctttgaaggataccgaagttgtcttgattccagcaggtgttccaagaaagccaggtatgacacgtgacgacttgttctctatcaatgctggtattgttcgtgatttggctggtgccattgccaagaatgctccaaacgctgccatcttggtcatctctaacccagttaactctacagttccaattgttgccgaagtgttgaaacaaaacggtgtttacaacccaaagaagttgttcggtgtcaccacattggatgtgatccgttcctccagatttatttctgagataaggaacaccgatccaaccaccgaacgtgtcaccgttgtcggtggtcactctggtattaccattctaccattgatctctcaaactaaacacaagtcgatgattcaaggtgaaactttggacaaattggtccacagaatccaattcggtggtgatgaagttgtccaagccaagaacggtgccggttctgctactctatctatggctgaagctggtgctcgtttcgccaacagcgtgttggctggtttcgaaggtgaaagagacgttgtcgaatccactttcgtggactctcctctatacaagagcgaaggtatcgaattctttgcttccccagtgactttgggtccagaaggtgttgaaaagattcacggaattggcgctttgtctgaaaaggaagaagaaatgttggccaaatgtaaggaaactttgaagaagaacattgaaaagggtcaaaaattcgtcaccggtaactaataaaatgaaagagacatcaaaagaggtctctctggatcatatatatatattccgcaagacgggatcatcttcatgcacttaaaataacttaaaatcatctataaattaacgattcatttatatatttatgtatattctttccacactactttttttttcccacatagtttaaattcgaaaacattcaaattgaaagctgttaaccatcccatactcaatatcgaggatttgagagtatattactttcatatttaagaattgtatactgcagtataactggtcacccatctccatggaaaaagcacagatatatgggaaacttgtggataaagaaagtcggtgtgaacactggcacggtccactggacgttatagccctccggttcaaatgctgtaacggatactatgcatgttacgagtgtcaccaggaattggtaccgcacgtcacagaaaggtacaatataaacgacgaaactgtcccgttggtcatatgcggcgtatgcaaacttgaaatgtcgtttgctgcatacagtgattcgttgcaatgtccgaattgcagatcgcaattcaacccaggctgtaaattacattacgatatgtattttatgaaagatgatgaaccagaaaatctccgatagataaatatatactgttctatcgcgctgcagtgctatcttcacctcttctcactttggttattgccacattgagtaacctacttgtcgatgggatgctgggtgactccgggtcacccatgctgttggaattggattcccttgatctcggtaaggtcggcgggccgatagcaacggcttctgatgccgctgtggaagcagcagaaactgaagcggcgtctactgccacggtagtagctctaggggaggcatccacgatagcacctggagcgcttaggtaatcgttcaaatcttttatgctgcgtcttccacgaagctctggagaaagtggcccattgttaccgcctaagaaagtcttgctagctgctatatctggcgtgccaattggtaccgtactactgccgctactgacgccctttcttatctcggcggcaaactggtcgaattttttgatggtctcgtcgcaatttccgacttgtcttgccactatccccatttggttctgttcatcggctaatgttgccccaccgcattgcagcaaaatcggcaaacattggatcgcgccgtattccatagctacgtgtaatcctgtgtttccctcttcgtcttccaatgttacgtccgcgccacattgtaagagaagagccaggcatcgggaatggttcgatcggcatgctatatggattggcgcccatcttctggcgctgctgcttcgcaggttcaacccttcttcgaggaaatgctgcaataatagatgtactgtttgttcatcccctttcgtaattgccaaatggatacacgtatccccgtcgtaggtttttaacattgcagtggcatcatgaccaagttggatcaaatggcggcaaatcaagtatctaccgtagaatgcagcgtaatgcaacgatgaccagccgttcgtactgtcgatgttctcgagcaggtctggccatcgtttgagaattcttctcacaacgcccaatttaccctggacaatcgcctctcttagtcttatccttggctcagggatcattggaacaaaattttataggtgcaaactgttctctctctttctttctcactctcttttctgtccatctattcttcactctagggtaaatacattgatttaagttattcctttattttaagattttattattgtactttttatcgctcgatgtttattgttctcttttttttacttataattttgatatactactaatgacaagtgaaaacgccagaagctgaaaaaccctgttaaactgctgtattgataatggaagaataagtgatgagcaaaggagaatatcaagaaaagtactatattaactcattcaatggccgataattctactaatcatcatccgaaagtgatattaccgagggaccaaactagcgttaatggttctgatgtgaacgatgccaattataacttaactgtagatcatgccttaaggtatcagaaactattggccaatagagcagggacgaacttggcaactggcccacttatgaccaaaaggttaagagaacagaaagaggggcaagattctgctagcgctcaggcagctcaaagtatagattatctttacataagagctaggttaccggatagaactgcgctggattatcaattgagtgttactagtacactccattcgttatatgagactataaggggatcactaatagagactgctgctgcgcaggtctcagtcagcttgtcgagccctttcatcaaactaaaggatgacgatactgttacactcttggatgctggatttagtaagaaaactctagttcttgtggaggttggtgattgttcgccaccatatctaaagcctcatcttttggcgaatgcaaaggcctatgcagaacaacaacagaaagaacaaaagatacaggagaattcaggtggggaatccattgcagaaggacccaagcccaccaggaaattgaccaaagcccctaaatggttgaagttaagcaaaaaataaataccaaaaaaatgcaatcattaaaacgcttatctagatatatacaggtaatcttcattcaacgtatctgtgaaacttcaaatcattcggattcaaccctaattgctgtaacttctcattcaattgatctttgctatagttgatcaatcgtaaatattccattagatcggccaataaattttggaagttctcctcgtcatctatgccagcgagttttaggttgttgagggctcttttgtcttctatttcttttaatttaaagcgtagagatctgactaattcagtgtcaagtgtgtcacgcttttccaacttcatctttagttgttcaatataatctttccttaaccctttcctaacatattctaccctggaaggggtaatgttcaacatctgaacgtcatgcatgtaacatagaacagcaaatagattattccattctttattagcggtgaatgcgcttataactatatttacaagttcatagttcaaaagagttccgtgctcgatagtcatcttattaaaaacatcgaacatcttataatcaagtctacttttgatgtcttttcgtttctgtaccgtagtgtgtatccagttatcactgcctcttagtttacaatttattagtctatagtatcctcggtatactttccagatctctttgtacaattttcgtggaggtatttcgcaagactttgacccaagagactctgaagtggagaaaaatctattaattagaacgatacaatcttcatatctctcctggcagaaaaaatgtctaagtaatgacaataacaacaacgaattgagtttcactttgttttcattagcacgctggatcatctgttccaccttaagctcggctgttctattcgacttgtttcgatagtactcggtgaaaagaaaataatggtgagaatttactggaggataaactgatgcgccttttttgactacatctttgttcgcttcttctttctttgcttcttctaactttgatagtaattttaatgcagcatcctcacgatcaccgatgagaagcagctttatgatcatttgtagctttttagatttaaactctaagttttgctcatcagattccgcagaaaagaattctagtaagtattgctgtaatacatcggaaacacgtctaaatctaaccaaatcgttcacattaccgtacaacaagtaactgaaactatttctaactttggagaagttatgtttttccattgcatcattataccaaccctttagttgctctaatttcttggttgcctcgtctggtgataaatatggttctaacgcttttccaaacgagtcaaactctttgagccattgtaatcttaatttcacaataagtgtattgaatagtactccgtccattttggtagactgttcaaaattggcgaataattgcataccttctttgctgaacccatatattatatatgaggaaatcatagataagtagtctttcttcgaaactttttgtttctcattgagaaagctgttcgcttcctctgaagaattgaagtttaaaaacccattcctcgacattgaaactgtgctgcgtccgccagcggcagcttcactagtattatcttccgcccaaccataggtcttaaccatagacagaagatgatctgtcaattgtctggccttttgcacatgtcttacgaacaatagttttctgatagcggatagtatgacatcaggtctaatataattctccccaaacgtgtccattgtttccaaatacaaattattaaacttatggaacttgttgctcctcaaataaatcatcataccaacttcataccaccaccgctcgttgacacgacgtttataactctcgaacaatgctgctgcagttttgaatttcctgaaatgtaaaagagaatcaatgtaaaaggattcatttccagggtccaatctgactttcttgagtccatagattagttggccagtaagatactgtcctctgagacggtatttcaaattaggtatcaatttcgataattcaaatgcttgtaccatttgatctaaggaaataatttgacttttatcgacaactgatgtgtcggataaagtcttctctaataaatctaaaagatgatttgtgttagtcaatgcatgtagcttgggtttcatttcatcgtaaaccacttgttgtataattttttcatcaaggttttctatatccgtggaatcgtcaaatatttcgctatccttattttgagtaaaatgacgattaatttcttcgggagacatggtttgaagtctttttatttcattttctgattccagaagtaagtattctaccacatccttcaatgaggtttccttctgtttctttaattttcgaagattcttctttgatttcttgaagcccggatttgtcaccgctaaatatgataagaaccaagaattcacaccagagtttatatcaacttcagtgaagtcatgttttttcaaaacagcaatgtcttgcttctcctgtatatgcattgcattatcagcatttttctttatagtggagatagtatttgataaacttttggttcgtatatatcgaagttgtcttggtgtaacgagtaaacttaatcgacttcgacaggttatcacattcagcattatgcaatatagaatctttctcttctgcaacgttgccttgtttcgctggagtgaacctcttcaacctcatctcatcgagataccttatttcatctatactattgcgtctgaaccattttcatgatttttcgaacgcagtttaaaatgaatgaaaagaaataaccgcacattggcttctgaaatccattattaaagactacatggtaatagagattttatgcattattacattctgggtttgattatatttatttttatatatcattgggtgtcagtatataaaaatagagatgcaaaagtaaaagtaaaaggttaatctataacttgaaaggatgaaatatgatattatgcttttatttgttggatggagaatattagttgattaaggctcatttcttcttgacacttttcatacgtccttcaaatcctgctcttttcttcaaatgggcagttcccttgaattttctcttcatcttctgttgtttgctcttcttcttacctttattgtcctttctaatctgtagattttcctctcttctcttctgtctttcggcaacagtgttttctaccacttgtttacgttcacgccattcgacggtcgacttacgcttcttagcctctttacgcttcaaagctttgcgaagtagtttctcatcatctttaagcctgataccttctgcttgcaacatggctttttgccatttttccttctctttcagtttaatttgatccaattcatctcttgattctaatgattgtttctttgtctctagcagtcttaaatgagctttaacgtcctttttggcaggtcccttttttctttcaccctttcttacatgcgataaatcagatgtagcctttgtaccgtcattgaattgaatactttggaacataacatctttggctgaaatctcttcatcaccattgcgacgatgtttcttggaaacgtgagcatcttctgcatccgagtccgaatcagaatctgcgctatcatcagaagacacatcaccagctttttcagaatctaacttggtggcccttgcctcttgtctacgttttctttgagcaagaatagcttctcttgaacttggcgcaccttccaccttggttcctggggcttttcttttctcctttaaagctttgattttctcctgtagtttacagcgtaattcttccatcttcttcttcttctgagaagagtcatctttggtacgttcgatggcctcctgttttttctgtatacgctctttctcttgcttctgtttgttctgatctactgggtttccatcatcatcaaagatcaccgctatactctcagattcgcccaaagtttgagaaatgtttatttccggtacttcgtcagattcttgttcctcggtttgctcctcctcgtcctcttcttcgtcctcttcgtcttcatcatcttcggacgatgtttcagactctgcgtctagtagttcacgttggatcttcttttggcctggtaaaaccacagctttcgcctgagcttgtttcttcttcataacttcgagggcagagctggattcatcgtcctgctgctcaggatccaatttcgatttcttatcctccttcaattgccctttgctcttcttcttggcattccattgttcctgtgtcttgtcatcgtagtaatatttcgcaggtatcaacgaaagtagcccttcaaaggcgctagaattcgatttcaaccgttcttcaagagaattgctcatgtcagggtggattggtacaactgagctgtgtaaataatatccttcttactaaacgaatcttagtactgataagtacattgctgtaagaacaagttaagtctctgtacctgtccggtgcgatgagctgaaaattttctatatacggttttgagaatatcacgtatggtgaatctttgaggtttcttttctacagggaaaattacaaaaaaaaaagaatacactttaaataagtcacgtgaccttagtcaaaacgagcggaagatgacttctgtatatacaatgtacagaagtactgtacagtaacagacttcaaccattttattgttgccacatgtacaccatcattcttctagccatttgacaatgccctcatagccaatgatacttgcccccaatcattacccacggctcatctctcgaagccaaaaattgaaaatccaaaacaaatttctttttgttccagccgctacgtgaaaagaagaagctctaaaggcctttcaattacttacttgatcactacagttaaaatagcccgtataaggaaaaatgactattcaaaatttttatgtttttccaagtttttttttttcttcagttttttttttcaaaacttctcacatttactttgtataaatatgttatgggtacgattaatagtaaattttttccattcttgttacttcgattcagaacacaattatttgtttgtgcagtgtgtgttcaagtttgattttcaatattcagttcaggtcataaggacgtccatacagaagcatctttttgttggatatcatttcataatggctcaaagcactttatttgttctgcctccttccccaagaagtatcttggctaaagctttggctaagtacttcaaggtagacgtcaacgttgttgatgttactgctgctgaaaataaggaattcaccagcaacttcccattgcataagacaccagctttcattggcgaagacggtttcaagttgcacgaattaattgctattgcttattacagtatgtgtgagattttttcacattttatttcaattgaatatattgaggttttccccgtcccttctgttctactcaattgaagccttggatgaatttaattttttatcttctgataatgatgagaacctttcaattatacagttatccctgtctgaatgggtaaaaagtttaataaaacatggtaacactcacgtgtcgaaaatgtatactctgacatcagaaatgaaaattaacaaaaaatcatcaattgcttcaaattgtttgaagaatggaacccatgggaaactcaatgactttctcatgtgttcctctttttactaacaaatttatccggaaatctttcccttttccccaatcgtatttgatcagtcgtcaacacctccgaagatgaagaattgaaggcttctctattgggtaagaacgctagagaagaagctgaaatcttgaaatgggtttctctatccaacagcgacatgccaaatgccgtgatgggcgctctcttgccaatcgttggtagggttccatacaacaagaaatccgttgacaccagcttggcacaattgaatgctatcggttccgtattcgaagccagattgaagaactacacttacttggctggcgagagaatcactttggctgatttgttcggtgctgctattttgtctaaagctttgtccactttgttggatgctaagtggagagctgccaaccctgccactgtcagatggttcaagaccgttgtcgcttccccaatcatctctgaagctttcggtaagaccgaattcgctgaagaagctttgaaatacactcctccaaagaaggaaaagaaggaacaaccaaagaaggaacaaccaaagaagaaggaagaagctgctgccgctccagctccagctgctgaagccgaacaaccaaagaagccaaagcatccattggaacttttgggtaaggccaccttcaacttggaagaatggaagagaacttactctaacgaagacacaagaccagttgccttaccatggttctgggaacacttcaaccctgaagaatactccatctggaaggttggttacaaatacaacgatgaattaaccttgactttcatgtccaacaacttagttggtggtttcttcaacagattgtccgcctctgttaaatacatgttcggttgtctagtcgtttatggtgaaaacaacaacaacggtattgtcggtgccatcgttgtccgtggtcaagactttgccccagccttcgatgtggctccagattgggaatcctacgaatactccaagttggacccaacaaaggaagaagacaaggaattcatcaacaacatgtgggcttgggataagccagttgttgttaacggtgaaaacaaggaaattgtcgatggtaaggtcttgaaataagcaagatgtttcactgcgctccaagcaatatttcatcaattcctaatctcgtttttttcacatactcttattttcaacctcttagtacattttccacttctcggtttgtataattaatttacgtacggctttaacttagttaaatctcatgaaatagaacacgaaaacaatctcatgaaattcaatggacactctttattgtaactgcaccagccagatatggtgcatgtcgttatacatttgactctttaatcacttcatacgatatttccttcatatggaagcattcaactaattttcgaaatcttcttaatagattaatctcgttttaaaatttaagaagtggatacaactgataggggttttcaaccataaagggtcaatgcaataggaaaaagagcagataagcagcccttttagtgagtaatctaatctccaatcgtttgctgcaatttacctaagaaaaaaagtcgtgacttctttttaagttttctcattttattctacacggtcaaactttaacatcctcattgatagtttgtacatcacgatagtcaccagccaaacatcagaaaaaaagatacagaatataaaactgattacaacatgacaactgcattgtacactgctaaagattttatactagtatccttgccggagaatgctaaaccttcacaaaaccctgagagagatgtttccacatggcttgaaactggattgatttctggtagaagttacgtatcagatttccctatcccagatttcaagattggatccttggatactcttgtcttacaatcggaggaattggcaaagattgattcccaaatctattcatcattacaaaaaatcgtggaaattttaaatgctttaactgacacacaagcttccgctatcagtattaataaacagtcgattcctgaatttttgacccatttccaatgggattcaagaaagttcaagcttgaaaaatctgtgaaagagttgattcacgatttatctatagaatccttccaattggatgcagatgtaagatcgacttattcaaactacaataatgctaagtccaacttcgcagctgccgaaagaaagaaaactggtgatttgtcagtaagatcattgcatgatattgtgaaggctgaagatttcattttaaacagtgaatatttgaccactgtattggtagcagtgcccaagaccttgaaacaggatttcgagaagcattacgagacattggcagagaaagtggtaccgggttcagcaacggtgttgaaacaagatgacgagtttattctttataacgtccaccttttcaaaaagtttcaacacgatttccaaaacgcctgcagagaaagaaaatacattccacgtgactttgcctattcagaagagttaattgatcagttgaaaaaagaacatgatacagccgccagccaagagcaaagtttacgtgtccaattgattagattggccaagactgctttccaagacgtgttcgtcaattggctgcacatcaaggctttacgtgtctacgtcgagagtgttttgcgttatggtttaccgccattctttctaacgaaaataattgcagttcctcccaagcaactatctgcatgcaagtcagagcttatcgaacagtttagctatttggcaggtaacgctttctctaaagataaacgtggtaagatcaaccgtaatgatacctcattacacgagtacgcttctttagttgatacagagtatgagccattcgtgttgtattccatccaactaccccaatgaaaccagaacaaacgatgaagtagaataagcatcatgcccgtaattcctgtaatatcatcatcatattatatagtgcagttcagtattcatcgtacatagactaaaaaaaacgtcaagaccaaaacgtgatcagaaaataacatgaccagagaaacagtcagaggtgagttgcgcattttttgagtctggaattttgagtatatatgcttgcactgttagacttttacggctctggagatcgagagtgccattatctgtcaaagacaacccttgatttcaccgcaatccgaagagaaatccggattatacccgtcagataaaaggcttggtagatataccgagaaagtatctccacacactgtcaaacttaaagtcttcctttgaaccgctattgcagaagtagccatagtttccatttttattctaggttactcttcgccggagacttctgactactttttcagtcttgccgatccctccaaattttgtctcattgtgtctttttaagtctttttccgaggtctgcctggcgacaaacacaaggaagagaaaatagtacgctatgaaagttaatgagatttggactagaaaagactcgaaattagaactagagtaacggctaataagtaattgctgcattagtaataagatgcagctacatgacgagtatctcaagtttgaaatatcccgtgatataagcattttgccggcatgaattgtaattttgctgaggcagtcatcgacgaggtgtgtcaatagtaattgaaccataatggtgtcttcaagtaagacttgggtgtcaattagcaattcataatatgaatcgtgaagtgttgctaatttactaagcataattactcatttacacccattcggtttcaggcattctggaataagatgtcaaggtaacaaacttatataaagaagaggtttgcacataatcacaacggtagtttgcaaaggtttaatttcgaagttgatgctcaattgtcaataaattaaacaaagcataataattgtaattcaacagacatcctgcctgttgacaagacacttaagttacaaggtattcttattcgtgtagtttcgggataaagagtcatcaaggaaaaaagtactgacgtccaaagtaacgatctcctccaaaaaaataaagttttaaaagatgcctgttgatatcgctaaaagatcagacggtaattacgacacccacttctatgctggtcaagatgagattggcaaggatggtgttttgaggattgcaaaggcttatagacaaaaggtggcatatccagattttttgccggcttggaatcctaatgaaaagtatccacctttggaattccacaagtttgaagaccctggtctaagagccgatccatctttcccaaatttgttgaatggcaaggtcactttaaagccaattactccaaaattaggtaccgagattaagggcttacaattaactcaattgagtgacgctgccaaagatgaattggctttgctcattgctcaaagaggtgttgtcattcttgaagatcaggattttgtcgacaagggccctggatacgctgaggaatacggcagacatttcgggaagttgcacatccaccaaacatccggtgctccggaaggccattcgcacttgcatgtgactttcaggcgtcctgaccgtactgaattcaatagagttttcagagacaaaactacttctattggtttccatactgatgtctcttatgaattacaaccggctggttataccttctttgctcaattggaaggtccagaatctggtggtgacactttgtttgcagacacgattgaagcttttgaaagactgtcgccacatttccaagagtatttgagcacattgcacgtgattcactcttcaaaagagcaagcgttcaattcaaagagtaacggtggtattcaaagaagagcaccagttacccacattcacccattggttagggttcatccagttttgaaaaagaaatcattgtttgttaatagatctttctcaagaagaatcgtagaattgaaaacaccagaatccgatttattgttggacttcttgtatagtttggttgaaaactcccacgatttgcaattgcgtgctagatggggaccccgtaccgttgctgtctgggataacagaagacttcaacattcagcttctgtggactgggaagatccagtcaccaggcacaacgtaagaattactccacaaggtgaaagaccggtagaggatctaaagtatttgaatgacccaacttatttcccgcaccgtgacgaagaggaggaagaagatgacgatagagtagtatactccaagtattgaattggctggccctacctctacaacaaaacctttttaacgaataattgttttttacggcgactactcttgatgagttttgctggcattctcctcttgtattttcactatgtaacatgtgtacgatgtcgaaaataaaacattcaaacttatggctctggcaaataataccttctatcgagtgacaaaacttttcattagtaatgagccccatgatcccactttagatccagctaatgctgttacaactactgctattgcgtataggtatagattcatcgagatgtatttccttaaaaagatctgcaggatccctaccaaaacgacctgccgttttaacaaaaacgttaataaccgtacaatagtttgtaaccccttcaaggatgtactcacaaggttatttaagtttcgcaaatttgattcaacctcttttgcctttaaaagagatctgtctgtttccttttctaaggccttaaattttacttcgatggtttgtgatacattttccaaatggcttgtaagttcaacattcatgttgtctaaattttcaacaatggaatttgacacacctctgacgacaggtaaaagatcgtcagtcaataatggtataacagattcatgcactagtttattgtattgaaatatgaggtgtatagtttcttcttgtgtctgcattaactcatcgctaattactagatttttatcacgggttaggtctattagatctgagaaaaagctgtcaataagttccatggatgtcttctggtgatccaagatataagtcgacatagattctaattcattgaaggctttgtctgtggaatttttgttcttttgaagttgtgccatgtattctgagtcgacttgccgaaaagtttcaattaagtgagattttattaatgatagatcttcattcacctcatcgttgagattgtcaaatgattcagtaaaattaaagaatcggatatcaaactctgccttcatcttgtcaaattcagtgattaattcttcgtccttcattttgtgattttggattaaatcattgaccagtgaattgaataaattttggatcatgtcaatattctccttaccattgatttctagatcagaactaaaacttttccaatagttttctatatttctttgaaattctgagtacatgtcagtaatattcaagaatagctcaaggatctgttccttttcgaacggtaacgaattctccatgcaaatatgtggaagattttgatagtttccactgtatgttgtccaccactgcggagatgactccaaagcattgacgcagcttatagtatctatcccacctaatcgtttttcatgacattcgcttgggtagttggttaacccagatgactcaaattcacaaactgataagcgtactgcggtgatgactctcaaatctgcatcaacaaattcgaaacctttcctcatacatatttcgagaaactctcccaaggcatttttaacacagcttgactgagtgatgggaaatttattattgatgtattcacgggataactctgttatttctagttgatcgagctccttttctattacgttagaaatatgtggcagtaattgaccggaagcgatccatatgctgaaaacaagaaaccacatgatggcttctcgtgaatggattagaacagtatcccaagcttggtgtgatctggtaattcattaacaagattttgcctcacccattttctaaatctccttttataccgtaagaatcaataccagaaagcagctgaaacagatgtgaaacatcaacaaaaaaaaatgtcactatattagcactatttacagtaattcgggagtaaggtttaaattgttttagtaatctataacatgtgtttgaacaatctatcattttgaatgttggaaactatgctctattgttcaaaaagtgcagtagcgtctctctatcaactccagtaaatccaaactgatcaataaaggtggtttgatttttgacaacttcgataactttggtgatctctttgacaggttgttcgttgataatggtctgtactgctctaaagttagagttagtgagtaatgctatgataaaagcaagaagatttgcattcggtacagttccattattgtatgccttaattctataatataatgaagaaatgttaagactattgtccacttgagagtccttcaactgtgcgattctaagcacgaagttgttgacacaagattttgcaatgtctttagagtattttgatttgagggctaagtccaacaaagcaaatatctctgattggtgaatacagtatggtaacaggagatcagtcattctgcatgttaaattagaggcgaataccggggaaagtacgtgcaaaagataaagttttgattttctttcaagtggaacaatgcctgcatctgtttcctgaccagcctgtccgacgagttcaatgtattcttctatggacggtagagatggcataatacggcgagatgccaaagtttctagtaaaatccgcgacaccttgatatccttaccctttaagaatgtatcaaaaagcttatcaagttgaacattgttgagattagttattatattttggtttaaagattccctgctactctttatcacgttccacagtaggttaagggctggtgtatcaattttcgtgaataactgttctcccgagagaacccattgaatcaataatgtgttgagcatatcaatatcatctatttccttaccaacatattttggtaaagttttcaaggtggccttccattgcggaactgttaagttgtctctctgcaatatgtacaaaaaaatctcctccaaatagataacttcctgacctttatggaatatgaatagcttgctcaattcactgtctaatgtctcgaatgacagctgtggatggctgttcaaaaagttgtctaattgtttaacaaatggagactccgaggtcagtttcgtttttctcacttttggtccggagtctgatgaagtaatgttgactttatgaaagagacggtctccggatttatgtattctctgaacccattttgatacatctttaactgtgtcaaaactcaatctggattccactagagtagattcacttgtcactgggtgtctcacaaatgctggtaataccggcttcccattgaaaagttttggattcctttcagtgatgcacaaagctgtgcgttcggtagcattaggatattggtagaatggatgtacaatcttgttagctgctggaaccacgtactcaggtagatgtccccattcttcatctgctactttgaatttgttttttggaaccagtagcgtcttgcccggttgcaacttattagcagctctagaaagtatactcatatcacgggaaaaaagatgagagagtgaaatgtagatagtagatgcagtggttaacgtcgtagccacagataatatatagttttccccagatgtgattggtgaacggtcccctataggtctaacgctgtaggttgagtttatctaccatgctgaaataaagctttttttttcagtttcgaaggtgcttgagaaaatacaagttcaacactgttcaaatcatcgtggaattacaattaagagacgcagcccagtaaagagcaccctgttcaaagaatatgatactcttttactacaccgaagacagcattagtttatatatatatatatataaactaattttctcttgatggtgttattccttctctatgttaaggcaatgatgagaatttgtcactgctgataaatggatatcgttccagtatagtattgaataatagactaatcgtttattatgagagttcctctgtaacgcttgaaagtgaagcaagagagttaggtgtgatatacattcaggacttcttgtcagccatcatcttatgccagatgtatcaacaatatcagttttttttttcattggcaatattgaatcgatgatgagctaagaaaattttcagcagaaacgtaaatagtagctatttccagagatgagatgcgatgagctatggaaaattacaagcttggttttgtcaaaggtcttttcagctttcttgagttgagattattgctattattgccaaccacttgctgtaaggagctagcagtgaggatctacagcttccttatttgttgacccactcgagtttgattcaactatagacctatcactcagatgggaaagaagagtaaagcggttcaagaccggcagaatgggaagtccattggaaagaagaaatccaatgcaaacccgttaaaacgtcacgctgggaagaagaccgtagttacttttgatgaccatcaagatggagatactggggattcggattccgaagccttggatcatgtgtcaaataaagagttaaagacaagggcactgaggttattgaaagggcgtgagagtttaccagtattccagaataaggaaaagatcgtgtctcacattaaagctaatccagttaccatattgattggtgaaacaggttctggtaaatctacacaaattccccaatttttgatggatgagatttctccgatgcacaaaggggccatagctgttactcaaccacgtagagttgcagcaatcaatcttgcaactcgggtggcgcaagagcacggatgtagaattggtcacgaagttggttattctgttcggtttgataataaaagtcacaagacaagaactaaattgaaatacttgacagatggtatgttaatcagagaattaatgctggacaagaacctatccaattataaatgcataatcatagatgaagcacatgagagaactatattgacggatttgattttaggttttttgaaggaacttcaactgaccaaaaggaaagatttgaaagtaatagtaatgtctgccacattacaagcagatctattcagcaaattcttttcgaacgcacctatactattcgttgaaggccgcaaattcaaagtagacagatattatctacccagaccttgtgaagatatagtggatagtgtggtacgctgttcagttcagttaaacagttcagaaactacaggagatatactctgttttttaccggggcaagaagagattgataaagcagtggccattttaaacaaaatcattccatatttagacgaatctgtaccacgcatcacagcatacccactttatgctgcattaccaccaaaagatcaagctaaagtcttcgaacctttaaagggattcaaaagaaaaatcgtattggcgactaacattgcggaaacatctgttaccattcctggagttaaatatgtgatagactgtggattaaggaaggtgaaagtttggaggcatcagttggggctagctacgttactaactgttcctgtttcaaaggctagtgtagcacaaagagccggtcgtgcaggcagagaaagttcaggtaaatgttttagattatttacagaagctgattacaaacaactgccgaaacaatctgagtccgaaattactcgatgtgaaattacgtcccctatcttgatgttgaaacagtacggcgtacaagatattgtaaactggtcgtggctagaacatccagggaaagaagctattatctcggggctaaaagaattatatgaacttggtgctctcaatgaacagggtcgtgtcactgatagaggtcgcaagatggcgctattacctttagcaccacatctaagtaacgttttgattcatgctcaagagactcaagtattgccatacgtcatagatatagtatcatgtctgagtgttgaaaacttggtgttaaacccattgcctgaggaacgagatgaggtcaacgaaagaagaagggcattatgtaccctaggcagtaagcacggtgacctaatcatgctaaaagagttattcgacatgtatcaatcattacaaagcaattcggagaaacaagaatggtgtaaacagttatgtgtatctcagcgtggattcaaaaacgtgattaaagtcagagaacagttgacagggtatatgaagagactgtacaatgaaccggtagaaattaaaacaaaacaggacaccctacaaccagaagaagacattgctacgaatctgttgcagccgccagacattgcgggtgttttaaaatgtttcctatatgggtttgtcaagaacactgcaattggaatgcctgataaatcttttagaacaacgccaacaggggaaccaatatcgatccatccgtcctcgatgttattcatgaatagtggcgatgaaataggtccatgccctgcgatattatacatcgaacacgtattcacaacaaagggatacgcgcggtctgtttctcgaattgaattggcatggctgcaagaaattgcctcaggcgttttgaagcaatcgacaagataatgagagaattattcgcggggtaaaggaactggtccatcaaccaaaattttccccgtacttcttcgcattcgaagtacagtaaatgcaggatctaaatagggaactgtatatattaattaatcacatcataacgatcatatgcgagcaaagcacagttaattgtaaatagtgtaaaacgaaaaaaaaaaaaaaaagaatgaaggcacatttgattttcactggtaatggcctgtgtgagttctttctgtacggcactttcagtcaaatctcttcaaacagctctcgaaacataatcgaacaataatgtgtgtccagatcggaatacagaataaagaaaacaccgaggaaagaaacggtttttccgtttgtggccgtacttctccaagaatttgtcgtggtatttttttttttatttttttttagtttttttttagttttttttttatttttgctcttggaatgggatgggaagagataattcaagttctacgtaaactcagtgggtatacaccagattgttccggtggttttcttattcttccgtatatagtgctctgtttataaaaagaaaaagcggcaagacttgcgtaattcactggttattggtgcagcgctgtcattagtaaaagtaccagctcaacaatgggtagtatggacgtagggaattacggtcgagagggtcaaggattgagtgggagggtcaagttgacccccgcccccgcgctcttttgaggctacatattaggtaccttgcaatactgcgcagtttcttaacgccattcctggcttttgaaacttttctgccaatgaaagacatcaaggaagaaagccatcctccgggttaacaacctatttattgaattagggcgcttcgaatacagtggttctgcacttttgagctatgtttgaattgatcgcctcccacccaccccgcttactttaatccattcttgctgcggcagctgtcatgttttcttaattattggagaataattgatagtgcttattgatcagctagagccattcggcaaatcgtacgtacaaatccattttattttagcagaatcatttgcttgtttgtagccttgtgaagtgtatctagtacctggttgtaggcccttgtcttctactcggctgttacgagagaatatccgtctgcggtcaaatctatactatataaaaaaacaaaaaaaaaaaaaaataataatacttgactacgggctcaaacagttctaggttaatatgatgtaatcataactttaaccctctcaactagctgtatcatttacgtttagacattctatcctttttattttttgtagttctaactttatttgaaactgcttcctatgcttgaacagttattcgtcataggtgtttctttttcagtaaccgtattcgtaattaaccagcttaacattttatatatatacatccaatattcctgctcatccatcccatttgcattcttattagttaaacacatttcaataaaatctggagtagttgttgtcatcttttgaaaatacgaaaatacgtatcaacaaactttctctactgtaaaactgctttctttcgagcgaatttttttttccttttataattaagatagcaaacatctggaggagttttaggtttcgaaatttcatcatgcttgccaaaattgttgataagttcacaaaaagaaccgatactgccggtttggtcggtagatcattgcgtttagcagtgacaattacagccgttactggtttttccttatttggttatgatcaaggtttgatgtccggtatcatcaccggtgtaagatttaacgatgagttcccaggtactaaggaaacttctgacgacgatagacacgctacagtggttcaaggtgccgttacatcctgttatgaattgggttgtttctttggttctttgttcgttatgatgagaggtgaaaaaattggtagaaaaccattgatcatcttcggtgctcttttgaccatcgttggtgctgtcatatctacagctgcctttggtgaccactggggtcttggtcaattcgttatcggtagggttatcaccggtctaggtaccggtatgaacacttctaccattccagtctggcaatcagaaatgtcgaagcctgaaaacagaggtctcttggtcaatttggaaggttccgtcattgctgtcggtaccatgattgcttactggattgatttcggtctatcttacgttgacacttctgttcaatggagattccctgtcgctatgcaaattttcttcgctattctattgatgattggtattgttcaattacctgattctcctcgttggttagtcgctcaagggcgtcgcgaagaagctatgtacgtcttgggtaaattggatgacttggatcctaatgatgaccaaattgttgccgaagtcagtactattcaagacgctgttaaccgtttcaagcaccaaaagagatctatgaaggaattactacacggtggtaagggtcaaaacctccaacgtgctttagtagctgcttcaactcaattcttccaacaatttactggttgtaatgccgctatctactattccaccgtgttgttcaaaaagactatcaaattagaagacagattatccttggttttgggtggtgttttcgccacaatttatgctctatctaccatcccatctttcttcttgattgaaaccttgggtagaagaaaattgtttatgttgggtgctttcggtcaaggttgttctttcttgattacatttgcctgtttggttcatgacactacacaaaatgctaagggtgcagccgttggtttgttcttgtttatcgtcttcttcggtatgtccattctatctctaccatggatttacccaccagaaattgcttctatgagagttcgttccatgactaatgccttttccacatgtaccaactggttgtgtaactttgccgttgtcatgtttaccccaattttcattcaagacgctggctggggttgctacttattcttcgcgtgtattaacttcctctatttgccagtcatcttcttcttctacccagaaactgcaggtagaactttggaagaaatcgatatcatcttcgccaagtcttacactgataagactgctgcatggagagtcgctgccaacttgccaaaactatctcttgctgaaatcgaagatcacggtaacgcgttgggtctatacgatgacgatctagaaaaggaagatgaattagaagaagacgttgacagcaaggaacaatctcatccaggtttctctttgttccaaagaaaaaagtcttctaagaacgttactgaaaataatgctgaaaagtccgatgcaactgctaacgataacactcaaaccccatccagtaacgaatctaacgaacaaaactaaacatcatcatgcagttaattcagtaacaatgtcaaataattttgctcgacgtaccatcttaatttctgtatcagggatgagatatgataaattttaatgaatagtggtacagtagtacgcgtacccttcaacattcacattccaacctttcactaatagtatattaattaataccataatattctctattgttatgtttagagtctcttccttgacatatctaacccagaagcttcagatgcttttcgtttgactacaggaagaggtgatattctgttccaataatattcaattgtccaatcatttactggaaatatgtacattgttaatcatagaagtataccaaatcattttattcgcatgcgaagactcttccaatacaagcacttatcaggacacacttcgcatgatcttctccataagttggtgtgttgatgtggttgaccttttatttttttcttccttgattctcccctcatcgctattaaatgcctatagagaaataaaagatgagattttccggaattaaacttctaaagcacgagaaagcccttttctgctatggctggttctatgtattatataccgaaagaagacataaatctaaacatcatcaacagtttaaagaagcttgaatagcaaaccggacttgaatcaagcctttaatttaatcaacagagcagtactttatactctttcgtttgcgtctaccgaactggaatcaatgttctttgaaagcatttcggtgcgtggtagcttcttttttttcaatatttttcacactaagcagcttttactatgggatgatgaatatcaacaaattctgaatatttttatctatagatatcgatcttgacattaagagtcatactgaatatgttaatgaaactgaaacttgtataaaaacaacccattggtttcataactttttttgtttccattaaacagattgagcatcggttagaaattgtgcttctggaaaaagccatttgtggagtaactctataacggaaaaccacgcatattatttaacgatgaaggtcactttttcgcttatgcagaaggcatcaaaacagatagataagttcgcattgtacgttcccaaaagcggcgtgtttcctaagggattcaaagtagccactcaagctactggtgtcaagaaaaatggcaatttagatctaggtatcattagaaatgttaatacatctcgtccatcgagtgctgctgctgtgtttactacaaataaattcaaggctgctccagttcttgtatctaaagaagtattggaagttactggtggtgagaatgttgatgctattgtggttaactctggatgtgctaatgccgttactggggaagtcggtttgaaagatgccagggaaatcgctggtgtggctaatcaaaacttgggtaaacaaaatgccactttggtcatgtccactggtgtcattgggcaaagattatcaatggataagattgtaccagctctatcgcaacaattcgaaaccaatgcgttcaaagatgatttcgaatcctggttgaatctggccagggcgatttccaccaccgataccttcccaaagcttatttcttccaatttcaaattggccaacggtactgagtatactcttaccggtattgctaagggtgccggtatgatttgccctaacatggctacattgttgggattcatcgttaccgatttgccaatcactccatctgcattgcaaaaaatgttgcgttccgccactgatcgttcctttaactgtatttcagtagatggtgatatgagtactaacgacactatcagtatgcttgccaacggtgctgtcgatacagctgttattgatgaaaacagtcaggattttgttcaagtacaaactcaagtaacagaatttgcccaacggttggcacaattagttgtccgtgatggtgaaggatccaccaaatttgttactgttaacgtcaagaacgccttgaatttcaaagatgctaagattatagcggaatctatttctaattctatgttggttaaaaccgctttatatggtcaagacgctaactggggcagaattctttgtgctattggatacgctaaattggacaacctacaatctttagatgataaaaagatcaatgtgtcctttgttgctactgataattcggaaccaaaggagttgaagctaatcgttgatggtgtaccacaacttgatattgatgaagcaagagcatctgaacttttggcacaacaagacttagaagtactagttgatctcggcactggttctgaagagtgtcaattctggacttgcgacttgactcatgagtacgtgactatcaacggtgactatcgttcgtaagtgtttagccttttactgcattaaatcacttataatatgtctataggacattccagatgaaactttcataatcttgttattaaacttaagtaaactattgaattgtgactttatcacttaaaaactctgaaaacgcatgagcttcaaagatagtaactttgaaatattgtcgctttggaagtactttcaaaagctcaacaatttcggggggaatggggtcttcattggctttgaattttttgaaagcttgtccgtcttcctcctctcgcattgtgcgtttgagattattagagccacgatccaaggcgattgcttcaggcatgacatcgcggaccatataatctagctctagcctttgcagataattaacatcgagcaccttatatttgttggtgaattcttctaacttgttcacttcaggaaacttctcaaagaatctcttttccaaagttctcacactatttagagaaccaaccttagattcaaagaatataactttttggaagatcatcttcaaaaggtgagaatctgagattttgtcaatactactctcaaacaaagatttgacttgagattcttcattgacatagataaggaagtccagatatttgttaatatactcaccatccgtagcaaaatatttaagtcccaattctagaaccttgcacgcagttttggtatccttgctgatgtggtactcgatatatgcgttctccaagtaaatatcgggtgttacaagtttttttaacctacggcatttgccaaagattttacgagacgctgcaagaccctgtatcctcttcattgtattcatgtatacgcagtatacgtatgttagttttgatttcagctggttgatagcactttcgtttgttggatcatcttccataagtgctgccaaatcaagatgtatgcggtcaatacacgataatattgtggtttctatctctggtattttggtatttaactcgtactgttctgaaaggctgaaagccaatactgcagaatttggtatgcattgctgtcctaacttcaagtacttagtaataacagtagaatcagtatttttctcgccttgatagtttgccatattgaaccaaatttcaggtgcaaagcagacatgctgcgctgcctgcatatatacatatgtcattctggccttgtgaaggtcatctgatagttccaacttgttgtctgattcccaacgaatccattccaaccatataagtaattgctgaacatcgtactcgttgggtttcggaagattggattcagtggcttgatttaacgtaattggtaaatttcttttcaatcctttcgtgatgttcaaccagtcctgatacaaagatctcgcattcatatactgggcagacagctctccgatgtgtctacgagcagtaagctgattaacatcctgttcccactgagtatatctttgccacatagattccaaacagtccattggttgacataatagagtcttgtataatttccttatatactgaactctctgttgctcctcaaacttgttgacaggcttccaatgctctaaaaagtgaaggtattcattccaaaattgtattgattttggttcgaaaatggcacacttatctaccacgacttggaaagcctgaattacgatgtttctcgcttcttcaccgccggtgataatgtcattcttctttctcacataagttatataagataaccataaagagagatcattgttccccaactctttggataaacagcgagctagcaccggttcaattacagcagcatctagctcttccatcttatcaaattcaaggctcaatctcatacaccaaatattggccattaatgggaatctgtcatgcaatttgtcgaacgtttcataaacctgtttccactgcttcaatgagacgtggtgtttaagtagcttcacatacagaaaaatatctgtaggttgctcttcgatcatatcatttagcttcccaataacatctgactcatctcgtaccctacttgtggggcgtagagatgttgatgtattgctactacttggaagtggatctggcgtagctgtaccgtctgacatatctcttttaatgtccagatgacgtcttagaaagatttctaatcccttttgatgtcaatacgtcaatttcagctgaagattttactggtctaaaaagtgttttctttataagcagctgagtctcagctctaatccatgtttatggtcgttccaatccatactaagttctttttaaatatgtacatcttggcttttctgcataatcagactagagattattttggatttttgacagcgattactggtactactttaaaggagggtaactctatcgcatcttgcaatgaagtttagtggaagtagcttggaacagtttgagatttgaatggaatcatcgaccagagagtagctgttgtgtgacacaggccatgcgcataacattgaagacgatataagcgagttttttgatgactcaatttgtgcagagtattaaaattcgatgagtggttcgaaagttttgcatttatgggggctcaatggagagccttctctagtttctccagaaagtattgcattatgttggttgttgaagggggggtatgttgccagtggaacggtccaggtagtttattcgaataacacagatctctcgccaacgggtgaattgcctatattgattgatacttctgctaagataacggttggattgtattcgatcattgaacacttggttcatgacaatgatgtgaagttactttcctctgcattgttgcagttcatctctgaagaattgaagacatgcaccatgtatcagttatatttgaatccagtcaattataacgaatacacaagtaagatatattcgtacctattgcattggccgttctggtataacactccgttgagtgctaggagccgtgccagggaattatgtcgggatattatggttacaatccctgaagatgaagaaaatgaaagcacaagcaatcaccaagatgaattgagtgagaaagccactgaattagctcaatctaaggtatttaaaattacaagagatagcaaaaggcagcaaaccaagaaacttcaagaactaaagaataactctaggttcacaacgaaactggacaacgttcttacaaattgggaaagtgcaagacaatctttggcatcagctgtattacctgcagatttagtacttgtagctcatttaaaggtacagatggccttacctcaaggtgacctgttaagatcgcatttaagaaatcaatatcctagtctttacgataaggttaacgaactcatagagaaatatgataactcaccagtaccaaacagggatccaacgtttagcgaaagtgggaacgtggtaacgtcaacatgctattttttgagaacgtttgtctagcgtatacataaaattaatgattttacaattcgaacaggttagcttttaggaaacgctccttttcaatttttcttgggcttccttaagcctttataaataaagtaatatacaactgtaccatcatcattaacaatccccaaggttaaccttttgatcatgtccggaagccgggaaaatatatggtccaaactcttcatcgagaaaccactatttttatattgatgcattagtataggataaacgtactcttttccgtcacttggtatatcctcgctgttgctagcatcggcatcattatcattatcatcattggttagtctatgagatggcttcccacaaactattggcacatcttcgaaatttataatctccgtctccgtccataattgctggtagactaaattagtgtaaaccacatcacaaagcgcagcattcatgctaaccatatacaaccctacaaaacacactaccgttcctggagtattggtggctatctaattgccatcccatcagaatcatcagtgtgaactcatctcatctttttgtccgttcacacagaaaagctcccgagttgtatttttccagcttcaaagatgtataaaaatgcatcaaacaatgtagaaaacatctggaaatttcaaacatcattaattcaagtatttagaataaaggtgatttgaattgtgagtctcctctgcaaactgtgacatttgaagtctgtttttatattgcagttgactacttagctcaattactttcgcagaatgattttagcatcctggttggtcttttcgctgttattcttacttgaatctgcgctaggatacagaaatgtgatccagccaaagcatactactaccacatcagaaaccccaaaaccatggatgcgtaccatttatgggacgcagcctgaaattgtgactcctactgtgattgctggtgtgactttcgggcatccaccaaaagttactccagatccattggaagcctgggtttcattaaagaaagatggttctccacagaccataaagccccaaatcaagaacggccgtacaaagaacccatcacctgattatgggacatactttaagactgcttcagttacaacttattccgaagaacagttaattgagatgggtatagatcctgaaggtccacatgaagaggaagtacttgcggatgaggaccttacctatttatcattgaaccctgttatcagatgtactcctgaccgttactttaacaaaggtttggctaaggacgaaactagtgcaccattctgtaccccaaaagaaaacgccgatttgaaagttgataagacatattttgtgtcatggttcactagattcttcgaaaatgatgacggtgtgaaggaagatgaagttcgtgttcatttatcatacgtccaggagaaagctcatgataagggatatgccaaaagagaaatgaaggctacgtttttctccagtgaatggttgaaaaatcttgacggtatgtatcctttggaagtaagggaagagtggctacagggatcatataataaaaaggtagttgtttctgttcagcctaagagtgttccagacgatgaattcgatccattggaacatggtgttgtaatcaacattatcttgggttccaaagtgttcaaaactaccaaagaacaattggccctagaggatcaaggtattactgacgatacttggtactatgttgcaatgaccatcccaacagcagtattatttgcagttgttttcatgtacttcttcgtacaacttaatgctagatacagagattttagcgatgttaaaagagacgcattgaatcaaaaacgtagagtcattggtaagttcaaagatatgaaaaaatacaagaacatcaagaatcacaaatatgacgaactccctctacacaaaagtagtaaacaaagttgaaaagtaacgaacgaatatgtatttactctatataaattttgtatagctaatattttatgtgcagtttgaacatttaataatcaaaattgacattagtcaccaaaatgaaaaagctgttaagaataagttaagaataagttgagaacgatgtaaactagccctttaaacttaacgaactataaaagacaatcttcagtgcttgaactcatgaatatacaataacaaatgctataaacctattcacctgtagaagaaaaatatcttttcatatccaattctccttggccgctacttcacagattttttccaaagtagctactcgaggatcaggctttctaggctctttgtctagtccatcctcaggatcaatgacttcgatatcaagactacttgactcatccggcaaatcctctatatagtaaaagaacggttcaagaacaaacattattttccaaaagtcaactgaaccgcagtttgcgaacagcacatcgatcaaactaggtagataaaccagctcaatatactcttccgcacagcatacaaactgatccaattggtaatcctgttcctctacactcaaagtagagtacatctccgataataaagtcaattctttgcttatggtttttggaatatcttgtcttgccttccaaagaagcttctgagcattagctaatttgacttccacattatcattatctgagctcgatttactatcgagcataaagccggaattctcactcttttctatcaagtcgttgtattcattgtacaaagaaataattttcatcataggtttgtacaactgttgacatacttttctctctgatttcggtatgataaccctttccagataatgattaatcaagccttccatgaaattagcccatatagaactgtagacgtagttttcgtcataaagtgtctcatcaaaattcttcttgatattctctctcatcacattttctaacaaagtacagaacaattttggttctttcttgatattttttggctccacttcttcctcataatccgagctattcggcttaccatgtttgtccaaccaatagtctgggccgcctcgttgtgagagtgttactagcaatagaaatagttttaatttatccattggcctgatcaattttagtactacattatcagaaatcttcgaaacatcatgattgatctttctgtgaatgcatgatatgaatgagtgtatgatacgtgctgtcctctggccataattggtgcttaaatactccatggatgttacagttttataatttgtgtcttggaacctcaaatctctagtaaattgaaacttgtatcgcacttgtttgcgcggcttgcgagttgcgtgtggcacacgagcttctgcggacattatcactatatcctgtacgttgtcgagtttctgtaacttgctaagggtaaggccagccacttgtcacctttacaaattccttcagtgaatgttgatgtcttccaagttttcaacacacttttgcagtatcaaaaagtgaaatttcaatagttttgtaaaggaaaaaacaagataaaccaataatgacaaacccaccgttagcatgtatgacaatactgaaattttatactgaaatatccaaaaagagtttattggatagaagataaatcgtttcaggttaatcaatgaactacagttttgtcttaacagtaatgtgaaatttcatacacggcaagttattgtcaacgtgagtgcacactaaaacggctaaaaagacgtaaaataaaaaatacattacaaaataatctactaaagatataggctgaactgcagttcaatggcaaagttctgaattaatgatagatctatggaatttccttgtttattatatttataggaaaagtataggcactgatcgaatgaattgggggtttggaaggataatattagttcattaaacgacatgaggtttactcaatgtttttagatgttctggaagaatcttcatccgagttgatatcagaaacgtcgaccttttcgacggcatctggatccatacctaagtctctgattatttcttcttctgacttcttaacacccatcaaaccgtaggttgatagggaaattaaaccaagaacacctgctagacaggaaaaggtcatagcaacaatacccttagcagtgaaaccatctggaatgttagccacttgaacgttttgaccgactagatccaagaaatcgttagtgtttcctgcagcgttaccttcccaagaaagaccgacattttcgcagacttgcttgtggttatcagtcaattgttgggattcagtgttttgcatttcttctggtgcttcaatcaacaacaatgcaagaccttgcttcaaatgccattcaatgtgacaatggaagaaccaaacacctggattgtcggctttgaaacgcaagactatactggattgtggattcacgtaaacggtatctctcatcattgggtaatctgggaaaggattgtggtcttctggatcgaatggatgaggtccttcaccaattgcatcatcgtaaccacgttctctgtcaaccaattggaaaatgtgaccgtgtaaatggaaaggatgcttaccagtatcgttgttattcaagacaatttcaataatttcatcctttttcaagacgaaagcatttgtgttggtaccataaaccaatggatttagtgcatctttaccagccgacaaagcagtcatcaatgttgggacctttggagcagtgaaagtcaaattattgaagaaagcgtaattgacaccatttttcaagttatccatgaccacatcaacggtaatagtataatcagggtcttcatacaattcgactttatccaatggggtcaaatagaaatcatccaagaaatcatctatgctgtctacatagctttgttcaggcttttctccatccttgtcgtacatcatgtaagaagtagcgttcaacatcaaatcgttaggaataacgtctaacatggtatcatcaaacttctgcatgatagcatagtttttagaagtgtcattcttagtgtgaatcaaaacggagtaacgttgtgccacagtgatgtaaagcatagaagttgtgtttttttcaacgtaaacaccatcaacttcaacgacagtcatatcatggtcctcaatccaaaagtattgtgagacgaatccaccagtattgacaattctcaagagatatgtagtatctggttcgacattccaggtcatgtttctagtgttgttaatgatcaaattctgaggaattggttcggcaccagttgggttgtaaacgttcatgaatttgcggtcaagggtatcgacattgtcataataccattcggcaagttgcacaacgacttcttcgtcataatcaaatggcaaagaatcctcaggctcaacaacaagagtacccttcataccgtcctggtattgaccaccagtgtgggaatggtaccagtaagtaccgtcgttatcatcgatggtgaaattgtacaacatggtgtcaccaggagcaataggacactgggtaatcatttctggcccatccatcatgttagttccgttctgggacaaaccatggaaatgtagggatgtgtttctatcatcgaatccatttgtcaaatacacttgaatacggtcacctctcttgacctttaggtcaggccatggaaattcaccattacaagtgataactggtctctcgaaattaccatcgacgttatagttaccccaaccagtggtccagttgaaggtatgagtggcagcttgagcaacagtagcccaactccacaaagccactagcaacgatggcaggaagtgatgagtcgataccttcatgtctttatacttccttttttcttctttttgttcttaaagaaaaccaatgagacttaaagatatgcgatgagatggttaacgcagatattgcaaataagaaagaaccctgaagacagataacaaaaatctcaactgagcaatatacacctcgtgcagaggcctaatgacaacattgagaacattttactgaaattaccattgtatatatacattaatatacacattctcacacgatagaaccaaccagtgataaaagaaagaaaaaaatccatctcaaacctctgtacaaaagcccactaccgaccgcgccgaacctactgcaatatgaagaaacgagatatcaccctcatgcacactacaataccctctgcctctacttctttgtgtttttcctccctcccgaactaaaccagtctctctaaactgtcaaatggttatgcctggtattgaaaagcacacctgcaaatagatagtaatatggaattaaaaaaaaaaaatcttgaggaaactagaaccaaaatacctaggtagtgccacaatactaagtcaaaaattaaacaattcggggtgtacaattcaagataataacctaattagcggaagtaaaaactgcgtaaagaaagagcaaggtaataatacacttactacgaggacttaaaggggaaaaacaactgataaacatggaaagagttagtcgaccaaacagaacgtccgctttcctgctttcctttctgagccaagaaactgccattcctatttttttttcttatgtacttgtttcactacgcttttatgagaattaaacaaagatgaagaaggaaaaaaaaaaaaaaaaggtcaactgtagcttgcctagtggtagctgtgagtgttgaaattggaattggaattatgattgtattgaaatgggaaaaaattgagatggtgggagagtaaacatcagggcccaactgtttgaatgggaaaaagaaaaaaaagaaaaaaacggaagtgctctacttcttgataataagtttccagggttttttgtaatggtagttgctacacccacccccgccggggttttcgagcgataaagtttcagccaattctttcctgccagtttacattctttttcttcattttattttttccttccttctataatttcttattcagttcaatggaatcggaaaaaaatatacaggctcgaatgagaaaggtttttgggcccaggcccaaaaatcaaggccccgaatagtctccatacattgccaagaaagtttttcagtttttagcttttctaaataactacaagataaggcgcagtatattgagaattggatttttttcatcaatgctaatagcggatcacttctccaccgttcttgttccgtaggtggaggagagcctttagggtgagaagcggatgaggaaagggtatccgtaacggccccatgtcactgaacgtgccagaagccctttgtgagcgagcaccaagatttgtcagttttgaatcttggcaaacgagtaaatcatgctcgattccgggccttttgcgttgtcattcttcttgagtaggtaatcggtacacatagaagtgtgctatatctaatctatcaacgatgccaagtttatctatggctgcacttgggccgaacgcccagtactgaacgtaggatacttgccaattttcgctttttcaatttatttttttatttcattacgaatgagaaatacattattgcacccagggaaatttcatggaatggtcagttttctactgtaggtcgaaactgcaactctcaaacttgctgtaattactctattttctatactctatatcgtaatgatgttcctatttaccagcgttctttttcttttttgataattttcatacaaacactttttttccaccatttttgaattgatatcgagttatgtacaatttgaacgagtcagtctaggtgtttaatccagaaccgtgaaaaaaacagggtgccattttatgattatgtgtatatatgcatgcgtatgtgaatctttttgtctctaacaccgataatatagtcttggctagttttctgttcagacggtattctgaaagctacatctgcttcgaccttcttaacaaaatcccgatccacgtgatcgaattatttgtcacaccgggtaattaacatatcttggttagcctttgtttaccatttatgcgaaatatggatctgatccaatgcataatatcatccatatgtctaaaaggtgcatatattttagaataagtggtaataacgccagttactggccagtactctagcaattgtcgacgatatcgaaatgtcgattgaaaaattcatctctcagccaccgctcatagttcattcttcgctttctcaactgcgatacctcgtgttatcagaagggttgtccgatgaagatcatcaacgtacaagatctcacgtttggtccatcctctcccgagcatcgctggaaaaatgtactcaggaatacctgcggctagtacaattaggcgcaccaccatcgaattggatctctaagattaaaaatgatactttcagaacgctatccacagatgaaaaatttaggaataaggtcactgaatcgcaactaattagagtcctatcttgtttcgcatgggatgttcttgatagtaaccaaacacatgaacttccaggtctttccccttatgtgcagggtatgaatgtgctgctggcaccctttctatacgtttgcccgaccgaacctattgcatataaactgttccattcgctttgcttccaaatgatacccacttatttgaaccagtctttatccggcgttcatgtagcagccaagttattggataaatgcttaaagatcattgaccctaaactgagtaaatttctaacagataatttattgacagcagagatatttggcattccctcaatattgactttgtccgcctgtaataaaccactggatcaggttattaaactatgggatttcatgttcgcttatggatttcatatgaatatccttttcattgtggctcagttagtcataaatagacaggctattatggtttcttcctctcctatgaaccttttacgtgagacaccgtctatcaatgcagatgaaatcatcaccctaggagttggttttctagcaaaactacctgatacgttgtatacaaatttggtagatcatcttacggatgaatcaattacaatgtctaaccatctataaaatacccatatcataatccgtctcgctatagtaactacatagaatggttctttggcagaactgtgacccaggtaacaccagcattgccttttcagcaccaactaaatccctgaacttaataaacaccttcccaatggaagaatgaatgtgactcatatcattacggtagtctgggttaggtaaggggatttggactgactccacttcaccacaactttgaattggcgtgccatacatcatagcttccttgatctcagtgacaaatttttcattcttcaaatccattggatcaacgctattcaatacacatacaaccttactaggctttttctcgtactttttaaccaggtgtgggaagttttcatatgtgattgatttgaaattctgctgcatactgctctggtttggtctgatggtcattggaagcttcttttgatcttctgctttgggttcatataataacgctttaatccatgaagttctctcgtcactcccttttaatttcattagctgtaaccaactgtattcgacttgttcatcaattaaccattgcttagtactttcttcgtcttcacattcggggccaagttttaacaacgaaagcactgatccatgatttatcggttgcacgtttcccgtgtcgttgacacatccattgggacgtgaccagataaactgactgctgatctttgattctaagtacttctggcacgttagtactatggtcacgaggctttctttattaaactccatgactattctgttcttttctattatgctgcttgtaacctcattttttgtgtccagatcgcagtcgacatcacctatgaattctttgattatagccacgaccgatacatgctcttcaaaaccgggaatcattggtgtgacaattagggtcctattcagtctgacatttgtgacattttttaaaatagtctcgtaaggcgggataacgcttctaccagtagcatttccatttataactgcatcctccgatgaccagctcgctgatgggttgggggtttttgtcctatacctttccgcttgagcatgcccaaacctgtttttgttaggttcgaaacgtccacgtgtgttatgagacagatctttcttccactctgtaggtttacgaaagttatggccttctgaatcatctgcttgattgtttttgacctgtaagttggtattccgcgaatgagaggcattacttgcatcagaccatctatttttgttgtcaaacctaccgttgcgcacttcatgccctctgttctgctggaagctgttgtcactgttgaatgccggtttagatattgatgaatcatttctctggaatcgactttgcctttccctgttatcctgtctgggactttttccatatctagaggtatgctgattcactggcggagccggacctcttctcgaatcctgctttctctgattcgcatagtccgcatgcgacggtccacgccttgtatcagttattgagtgattgttgttgcggttagaacgagacggacttggtgacgccctttgaggtcctccgggattttgatgtactgatttcacattattttgtccttttccacctgtaacattaacatcagtatttctggctaccttgtcttctttacgctcatgtggcaacggttctgaatttttctgcccatcgctagtattctccaaagcttttgacgtactctttccagtcacttctgctagaattttactgcgcaaagcagccatataatcctggcctgacattttgactgtttactgctaatgttgacagttgagtcaaattttagaaaggaggacgttcgaaagcccggtatttcaagagaaatgttacatgtttctaatgaaactgatcccagcacattgtaagttgtttgaacttcaaatactttcgatgggaatttcatcctggtgaaaaaatgtcaaaatcacgtgatagattctggtattacgtgtcaaaagttacatcgaattgcatagaaataactactttaactgctgtgataaagacctacctcttttaagacgctcacctttacaatattttataattcatattgaatcaaataccaggcaaaaataaaggagaaggaacagctatgcgaatagtgttttggtttttgttggcaatacagtctctaaccacctgttttgcggcggtcgttggtttagatttcggtacgcactatgtaaaagagatggtggtctctttgaaggccccgttagagatcgtattgaatcctgaatctaagagaaaggatgctagtgcgttagcaattagatcatgggatagtcagaactatttggaaaggttttatggaagttctgcggtagccttggcaactcgattcccatcaacaacatttatgcacttgaaaagtctattggggaaacattatgaggataatctgttctattatcatagggaacatccagggttagagttcgttaatgacgcttctcgtaatgccattgctttcgaaattgacactaacaccactctctctgtggaagaattggtttcaatgaatttgaagcaatatatggaaagagctaaccaattattgaaagaaagtgatgatagtgacaacgttaaatctgtggctatcgctattccagaatacttcagtcaagaacaaagggctgcattgttagatgcaacttatcttgccggaataggacaaacttatctttgcaatgatgctattgcagttgcaattgactatgcttccaagcagaaatcgtttccagcgggtaagccaaattaccatgttatctatgacatgggagcagggtctacaaccgcatcattaatttcaattttacaaccagaaaatatcactttgcccctaagaatagagtttttagggtacggtcatacagaatccttatccggatctgtattatcattggctatagttgatctacttgagaacgacttcttagaatccaatcccaacattagaacagagcaattcgaatctgatgccagtgcaaaagcaaagctagtccaagcggcagagaaagcaaagttggtcctaagtgccaactctgatgcatctatatcgattgaatcattatatcatgatttggacttcaaaactactattactagagcaaagtttgaagaattcgtggcagaattacaatccgttgttatagaaccaattttgtccacgctagaatctccattgaacggtaaagcactgaatgttaaagatttggattctgtgatattaactggtggttctactagggtgcctttcgtcaaaaagcaattggaaaaccatctaggagccagcttaatttctaaaaatgtcaactctgatgaatctgccgtcaatggagcagccattcgtggcgtccaattatccaaggaattcaagacgcgaccaatgaaagtcatagatagaactactcattcttttggattttctattcaaaacactaatatatcaaagcttgtttttgatgcaggctccgaatatccgaaagagatcaatttacaattgccaggtatggaattaaaggatactgttttgaaaattgatctaacagaagacgaaagagttttcaaaactatctttgctgatgtggattctaaattgcaatcttcgagcctatccaattgttcgaccgctgtgacatacaatgtaactctctcgttaaacaccgatcaagtattcgacgtacaaagcgtcgtagcctcttgcctgactcacgaggaggtccccacaggaactgagaaggagcacaaaagaacagtttcagaacacatacaaaaacaccctatccctcatactgtggagttcacatgtgtaaaaccgctctcaaacacggagaagaaggaaaggttcaacaagcttcacaagtgggatcagaaagataaacttcttttggaaagacaacgattactcaatgatttagaagcttcactttacgctgctcgagaattggttgaagatgcgaaagaattagagaccccaccaacatcatacattcaacaattagagaatatgataactcaatacttagagtttgttgatgatccttcttcgctcaggacaaaaaatatcaaaaccatgaagagtaatctagccgagttacagcaaagattagagatttacatggatcgtgataacaaacaactagacgtggaaggatttagagcattatttgacaaaggtgaaaagtatctggaattgttgtcaaaaattcaacaaaaaagtctcagtgaactttcacctttgaacaaaaattttgagagcttgggtcttaatgttagtgaagagtatacgaaagtgaagcctccaaagtcgaagaccgtgccatttgaaattttaaatgggacaatagatctcttgcattctcaattaaagcacatcagggatattattgaagataataattccacgtatgctattgaggatttatttgaacagaaacttgaggtcgattcgttatatgaaaagattgaacttttggtgaaaaaaataagagcagagcataagtaccgtttgaagttgcttcaatccgtttatgatagaagattgactgctcaaaagagagaacaagaaattgccaaagaggctcagcaagctgacggtgaaaataacgattcgattaaaaccatggaagaagagtcgatagaggagcatgaagatgctaattttgaacaagatgaattataatcgtcatttcacattatgtacataaatttgtgtaaagaattaaataaagttctttctaacgtattattcgttgttacccacttgttgttccactttatcaaatgagaatggttcgtatgcgtaaccttcaccttcaaagaacttagacatcgcttcgacccagtgcaaacgcaaggcatgcaacattgcagaagtaccttccataaggaccaagatgcaaacggttaaaacaaaccacataccaaacaataatacaactttggcaacggctaaaggagaacccgaattctgcgggctaaaagcattcgcaatcgtcatagtccataagaccgttgataactgggcatgagccaaagataaagcccataatcttaagtaagaggcagtgtgtgatatgcagttcaaacaaaattcaatcgtatggatcacttgatgaatcataatgtcgccaaaattgaaagaagcatgttcgtgttctttgctataatctgcgaccaccatggtatcctcagaattttcttgcgcttcttgcaaacgctcatgaatttcttgttcatgcatatcagagtatcccttattaatggcctcctggttcagcttctttagtactagcggtttgtacaatagtagccacggtacacaaactaaggcagcaagtaagaggataatctgtagaacactttgtccacggaataaaggctcttcgataacaccaggggaaaggaacatattgattaacatattcaaaagtcccggagcgggcttattatcttttatccagtctttcgaccacttgtatataatagcccatgaaaggtaaccgaaaatggactgcatgaaaattaaaccaggaataaaattgccaacgatatctactctggatttcttaaatctgtagttgaccaaagaaaacatgaatgaataagtcatgtgaatgaaacccattaaaatggataacttcattttatacgagttagaaaataaaagagcattttcagttccatgccaagcgtaatctaaaccgaaaggataaaccccgacctgcgttgcttcaattgtgtcgccttctttgaatccactgggccatttccaacctgacttgaacaaagtcatggaaagtgaaaaaatgtcattgtataaaagaccggtataaatggagaataaacccatcaataacaacacatatctacctgaaaaagccatatcgaaaatctcatctcttttcatctgaccgaatttcttttctctcaaaaccaacaccaatccacaaagtgttaaaatgaatccatgacccaagtcaccaaacattatggcgaacataaaaggaaacgtaacaatggtcgccaaacctggattgacttccttatatgtagcggtaccgtacgcatccacaatattttgaaatgcctctgtgaatttattggttttgtgatacgttggaggacttttattggtagaaataacgttcaatactgctgtactggcagacgcagatacttcaccaaaatcccttaacgagtttcttacggcatccagccgagaagaaggaacccaaccttcagccactaccgcttgagattcttgcctgaacaaatttaatgtagcataaatatacttctctctcttgactaatacattccaaatgggtaattgatcatttacaatcaaaagttctgtgtgcaaagtttgttcggtggtagtgcagatctgttcaagatcagtgattttatcattcaatgcttgaatagtggaatgactggttgagatgggaaataaggttccatttagagattctactaccttccgaactctcttcaataaaacatcaccatgggtgaagacaataaaacaatctttctcgataagttcatctccctctaaaagcttctgttcaataggaatattatgaaagaacaaattacctcttaaaattctccataaaattttattcaaaatagccaccttggccctgctaattgagcccgtcaacataaatttgttatggtaggccaattccatactgtttctcgttggttcgtctgtgtccaaatcaaatgagaaatcacttaattggtcggactgagtttcttgatccgctgaaaggttgaattcctcaacatccatagaagagcgtattcttccacctatattaggatttacttctaaaaatcttccagtttcaaagactacatgtctctcttctatcaatacattgagtcttcgttttaaatgtatcaaggattcgtcaagttgccttactcttgcttcaaattgaacaatatcatcggaaacgtcgtttattgtatctatagtatgatggtttaggctttccaaaatcatcttggtggaagatccaaatgttcccattggatcatccacgtctaccggatgataagtatatttccatgtagcatctttatgacgttcagacactgttataagatactggaccaatctatcaatatcatcgtattttcttatttgattcacatgtcccctttgaaacgcacttacgccagcgttcatgtctttaaacattatagcacccatattgccaaggatacatacgacttctcgagatatttcggatggaatatatagctcaacatacgtcatatcagccgaccgaaagatggcctcttccgcacaatcaagagtcaaatattctgggtttgacatggctcaagtaattagcgtttaccaatctctattccactattcaaaacgagctttaatttaacggaaatgtaaatacttcctttccaatatttcagtaatgagatccctattccaatagacaaaagttctctgcgaaaatgccagactacctgtttcaaattcggaacaagttgttccaatgtaaatgctaataccgttgctatcttcgggttctgcttctaacaattggccgcgttctgtcaacaaaaaggtgtactaaatatgcaagattttggttacgtatagcgattgttctcctaaatttaagaacatgacaaaagaagaaaaagacgggtaagtacaaataaggttacaacacactcggttatagaaagaagccagcttgaagcactgttcatcgaccatcaaggactgaaatatgcaaagtcctagtcatgtcgatttggcgtctccaccaaggatacctggtactccagttcctgtgaagttgaagtcaaaaaatagcacgaagcagctggttaaaacagcgaagtacttgtttccggattacatggggttgttcaatctaggaatattgaaacacgaagagttacagtattgtgagtataccattaatggctttgaattatatattgtggagcaatgggtctcagaaagaaagttttctaatgttatcacttcatttacaggaaattcaagcgaagtagttcgtggtattttggtgaaacttccagaggacataaggtactggccagaatctttcaagcaataccacgacaagctaattgaattttcgtcaatcaaagtgatggatgatggcatttccttatttgtcaccaatttatcctatttcccgtcgactcttaatttattgcatgtgaagaatgggtcaatgaaggattcctggccattatttcaagtaaacttcaatttaaaacgtattggctgtggtagcagatccggaaatttattaggcgagccctctattacatcactagagaaatttgcgcagatttacaagatggccaccaaagatcctgaggatttgtttcgaaatttaattgagttgtttagagtaatacaaatatccttaacgtattttaggttgttagatggaaggtttaaagatggtactctttgtcagcacacctttgatggtatacaggaatggtgggttacgtatggtaaactatacttgggaattgataggccgaaaaatgaaggaattctagggcctaccacagttgcaggtataataagttttgtattgacatgttacttcaagttcattgtggaagattgcatatcattcaaagacccttatatagaaagttccttctactctggggtgtacaactttcaaaagaaacacaatcttccgaagacgtcttatctagatatagaaacgatgaacaaacttttcaaagttacttctagggcaaataccacagatattttcaagttaaagcgtgctttaaaatctagggtacaggatattgctagaaaagtcaatcctatccaactagctaacgaaattttaacaacagatcttgattggttgatagaaaatgtccaaggcggatatcttggactattttggagtggaaagaggcaaaataaaataactttacagagccataacttttatgaacaggattacagtcatggggatccgttcgatgaacacggtgagtattttaccggagaaggaatctatgattatgaggagaatagctcagaattggaagatatatcaagttgggaggatggcaacgtaaagcacgaatctgaatttccttatcattgtcacaataatgtcatgttccaaagggagctatatcgtagagcttccatacctcagaccgagaaggaaaagaatctttttcaaatggaatacaagaacagtgtctcagccgacgagaactcggggcaacagtacacgattaaacataactacagcttctcggatatacaagattccatagaagtgtggagttttccatttcaagtatcgcctgttaaaatcgctagggacatactgcgcatggaggtacatatgagaaaatattgtgatgagcgtaccacagaaagctggaatgactgtatggcaacattaacctcatcattaaaacgttgcacagagacttttgagactctccaacaaaaagagaacgaactgcggtctaagcatgacaccatacaagctgaaatgaaagacataaactcattagaagctaaatttaactatgatttgaggatccttgatgcaagaatgagagacgttgaggaaaatttgaaccattttagcaacagattgaacacattagaagatagcttcaaactgaagggtaagaaatttaaagcattaattgatactgacattctacacagtgctctagagttagacaaatatgcatttgaattcttcgaaaatgagcaagtttggaacgagggtgtctttttgagatcaatgagacagtatatatggcctgtggtgaagaaggaatgggaaagactgagtgaatggtggagcccaacgaatatgtagtgtttttttttgcttgcatcatttcaatgcaattgattccggaacaatctttgtttgatatttatcttcaaaatctccgatcacatttttaagccgtagatagtttaggttatcattcggtaccttatgccatggtactctattgaatagatccgtcaattctcccatcaatatttttaattgcttttcggcattaatgtggccatcatttagttgtttctcgctatacttgagtcgtgacattggtgctgtaacactttttgttatgaattcttgttgtttctgtggcgctgatgttttatattctacgataaagttacgcattgatactatcatctcgtctatttgttggataagcagatatatcttcgagtgaatgtattcttgatgttcgatctggtacattaaccgatagttttcttcgaccagttcttcttccttagttttttgctttaaagtattgacttgtcctagcgtttcatcattaggagatttcgaatattcgttgtaacttatctgattctgcttcgctagcctcttcaatgactgctccactttttctgtctgttgtctcgttgcccaagcctgagagctcaaagtcttcatcaactgaagaaggtactcaaaactgtctccagatccctccatcgtgtacggcagaagttattgtttatggtaatgaagccaataagcaatttatcaatacttttcatcacatgattgttgctaggagctcaagtttccattatttcttgttgttgaattttaaaccttaattttatgtccaatcttataacatcaggacaaggacaatagcgctacaggtgatcatacctaattatctttgagaaagtacactatcttattttcgtttatctaactgcctccctggctcatatattaatgaaaacatcttaaatatactcatgatatgctaaatgaattgtttgatatagcttactagattcattgttccattcaagaatgaagcggtggctcaatggtagagctttcgactccagttaaattctgggaattttccaaggaaacaaaattgcaatcgaagggttgcaggttcaattcctgtccgtttcatttttttagtttttgtttaagatgactgactcaacaaatgcagggaaccacggtctgagtcaaagcgtagtgagagcagacattggtcactgtgtgacgagaacagctccctcaaatagtaaagtaatgcgccttttctttcttcggtggatttgaaaagaatttaacattttcggatctgactattagagttctttaaacagtacttgttgtaaatcagattttgaaccttgattttacacaggagaaatttatgttgaaaatacaagtaaatattgttaactaaactttgctttagagtctacgctgcgtctcttaactaaaaggctggctacaaaatatcgacctctatttaatatgggagaagacggtaaacatcacgcagactactcttcattccaaacaacagacaggaaaaaagctctcgagcaactcttgatttcatatgaggctttagcagaaggtcaagacaactgggtctgcaatctggcgaacgccgcatcattaatctggcattgttacatatcacttaatgttgacgttaactgggctgggttctacctcactcggagagagaataaaaaagagttgattcttgggccatttcaaggcaaagttgcttgtcagttgattcaatttggtaaaggagtgtgtggtactgctgcgtctagtcaacaaactcaattagtaccagatgttgaaaacttcccagggcatatagcatgtgatggggagacaaagagtgaaattgtggttcctatagtccaaaatggcgaaacagtaggtgttatcgatattgactgtttggactacaacgggtttactaagcttgaccaagaatttctagaaaaattggccgcttcagtttcaaagacatgcgtattctaactcattaagtagttacactcgttaattatattctctcaattgatatcacaactcttgaccgtatatgaagttgcctgttattgcatacctaacatagggcatgctgccccaggtccagtggaacagaagttttctagttttcaatgaaaaaaatgatttcgcccaggatcgaactggggacgttctgcgtgttaagcagatgccataaccgactagaccacgaaaccatcttgtgaggtctgtcgtaatatagactgaagacaagccagacgagaggtcatgtgagctagccagcacacggcagagttccaagacgtcagtgactgggcatatggatcctgtggtatccagaagggatggcctagatggatcatagacggtcacgtgatggtcttgagtgcgcgtggaggacggtagctgcagaggacctacaagggcatggaggcaatgagttgccatgacgaagtctgacgaccatccgagtatataagtcgagtataaaaggctgagctatgttgcgacctcttggggaggttggacgcatatactcaacgatctaactaaatagattattatattatattcgttatattgtttgatatcaacgatccctcatcaggcgattaatcaatcaactatcatccaaggcatatcacaacaagatctgagagaactacatgagtatatgttacatcgttaagagtttctgaagaaacgaaataggtctctcttatcagcgccccaaattggaataatgaagtttactggaaatagcttcttcaatgatgaaattacaaacttgaaaacgatgttgcatctactagaataaaactaagataactgtctatgatgcaaaaaaaataagagttaagaattacattcattgtaggctagcgaccaaagtaaatatcttcaacgtaagtagaagtatatgtggagttgattgaataccagttccctatctttgctgaagggtactttgactttttcaaaatagcattcttgttcaaaactttgtagaagtaattaatgtatcgtaattttctttctttttgtttcttaaaattttcaattttcatcttgagagatgagatgagatgagctgaagtgaatagaccacagagataaccagtacttctcaaagttaacggcatcagaagaagctctgaaagtatagagagccagaaaacaataccagaaactatggccagaaagaattcttctttgaatggttctgaatcagcggagcttgttgtaaaaaagagagttctcgaggaatctgaattgtccgattctgaagatgaaagaattgaagttgatggtttaatcgatgaagaggctagcgaaaatgaagctgaggaagctgaagatgacgactctgatgctgaattcaatcgcttattagctgaagaagaaaatggacaggaggaggagtataatacttcagatttttctgaagaaggcgatgctttttccattaccgacaaattgtcaaatgtaaagttaacagtgattccagaaacaagcgatgaaggcattgttcgtaccaagtattcagatggaagaccaagaattcttaagtcagaaattaatcctgtttatgatagtgatgatagtgatgcagaagctaagaacacaattggtaacatcccactatctgcatatgatgaaatgccacatattggttatgacattaatggtaagagaataatgagaccagccaaaggatctgctttagatcaattattggaatctatagaattgccagagggttggacaggtttactagacaaagacagcggtgcctctttgaatttgaccgaagaagaacttgaattaatcaataagttgcaaaataatcaacagacggacgaatctgtgaatccatacgaacctttaatcgactggttcactagacacgaatctgtaatgccagttacggccgtcccagaaccgaaaagacgtttcgttccgtcaaagcacgaagccaagcgtgtgatgaaaatagtcaaagcaatcagagaaggtagaattatcccaccaaagaaactaaaggaattaagagaaaaagaagaacaagacagtcataactacgatctctggggagatgccgaagaaatctctgaacatgttatgaacttgagagccccaaaattgccaccaccaacaaatgaggagtcttacaaccctccggaagagtatcttttgaccccagaggaaattgatgcatgggaaaagatggaaccaagtgaaagagagagaaattttgtgcctcacaaattcgctgcattaagaaaagttccaggttactctgaatctgtcagagaaaggtttgaaagatcattagatttgtatttagcgcctcgtgttcgcaaaaataagttgaacattgatcctgaatctttgatcccagaattgccctctacaaaagatttgagaccatttccaatccgttgctctaccgtttatgtcggtcataaaggaaaaattcgtacaatgtccattgatccaactggattatggttggctactggttccgatgatggcactgtcagagtatgggaaattcttacaggtagagaagtttaccaagtcacaatacttaatgcggaagaaaacaatgatgaccacatagacgttgttgaatggaatcccgacagtactaccggtatccttgcggttactgctggcgaaaacatcttcttgcttgttccaccaattttcggctttgaaattgaaaacacaggtaaatcaaagattgaatacggttttggtttcgatactttcggaaacgtcaaaaagagtaatctcaatgtgaatagcgatgatgaggatgacggtgctgaatcacatgctgtcaagaaacaggttgctcaatggaataaaccaaccgaaaggcaagctgccaatgatatttgtatcgtaataacttgtcgtaaatcagtgaaaaagctttcatggcatagaaaaggtgattactttgtcactgttcaaccagactcaggtaatacatcagttttgattcatcaattatccaagcatttaactcaatcgccattcaaaaaatctaagggtatcattatggatgcaaaattccatccattcaagccacagctcttggtctgttctcaaagatacgtcagaatttatgacctatcgcaacaagtgctaatcaagaaacttctacctggtgctcgttggttatctactattgatattcacccaagaggtgataacttaattgcatcctcgtttgacaagagagtgttgtggcatgatcttgaccttgcaagcactccatataagaccttgagataccatgagaaggctgtaagaagcgtaagtttccacaagaaactaccactgttttgctcagctgcggatgatggtaacatccatgttttccatgccacggtctatgacgatttaatgaagaaccctatgatcgtcccgttgaagaaactaaccggccacaagattgtgaatagtttaggtgttctagatactatatggcatccacgtgaagcttggctattctctgcaggtgccgacaaaaccgctcgtttgtggactacctgatagaaccctcatgacgggatatttgtaaaacactgtatactatggacatcattacctatcaatattacaagtagatactttctaattagtgttcaagggaatacattattatctttggatcagagctcaaaaggtatccatgtctctcatcattgccatttcctcatctgatgcgatatcattaccgttatttgttgtgctggcaacggtcgtaattttactcaattcgtctaactcttcagcgttaggcagagcgtagccattttgtgtatgttgccgtatgtttgtatcagtggtggacaacatttcattcgtgtgccgctggtgatgcgaagaatatagaacatcatcatcatcatcatcatcatcatcatcgtcatagttgccgtcattattctgatttttgtctttgtctaggctgataattttggtggcttcataaccatactgtgcatttccgcggtcagtcgctgaggtagattcatccgttacaaataagctatttcgtccctgatgagcaggtagtacgcctgtgtcgtgcatttgcatatcaggtacgttgggaatgtcatctccgaggaggatacccatgtctttcctaactaaattcattctatactctcttagctctttgtcagttttccccaatgattcacataatgaggtgaaatctttgaactttgccttcggatacaaattatgagcccatagctgatagaattgtaagaagtttgttaagttatcgtaagctgtcttgtgcttgctgattctacaacttttcggagcatgttccatgacatacggcagacccttagtggacaataacttctcggcagtaagctttacccttggtttccgggtgttggtagatatgagcgtgggatcttgaccatcagttgtacttgtcatagaaggatccaggccattcacagtaggatccaattcaaaatcaagcctcatgttcccatcttcagtcgcgttgccttgaaatgccgagagatcgttcatatcatcatctatagacatcgtttacggtactgtctcaaaaaagcaaagagcacacacacttgtagatataaaaaatactattccgtgccaaatatgaggacttcgacaactgagagcgagagacactatttatgttatcttaaatcgataatgctcttcgacttcagttaagtttggcgtagtatatttcacggaaaggaaaagaaataaagtcacgtgaacaatatttacattttcttttggttcgtctggtgacattatcagcgtcaagaatctcaacgcagacatttattgcgacagacacagtgacgcgtcgaaaagtcaagagaaggcattcagggggaatgccaagagacaacaaaacgggcaagcaaaaagaagcaccgtgaaattttaagtcaaggctgtccttctgataagcaagatagcaagccaaacactatgttttggctgcgttgataagaagacaaatgctgtcaatcacgtgataatccctcttttttaagttttcttgggggcattcattaggcgcatgtcacatgctctgttgaggaatgagtggaaagccacactttttattgcggtactttcacttaggctgatgaaaagatcggtgtttgaagttcctgctgagaggttattgtgaaagtgtcaaatgataacgcacattaacgggctgccttttgattcctttgcccacagaagtggtccattttgtttcagagatttaaccacaatttgttagtgtgttattgttatcttgttgtagtatattttatggaggttatatatatataaggaataacctttcagttgttgacaaggcctatgtaatagattcgaggttgtctgtatcttgtattgataagttaaaaagtgtaagaaagacgtctcataataaggagtaacacaggataccgacctccgaataggcttaacaagcgcctactacaatatacccattagcgtccccgtttgacaatattcaacaatgttcacagacaattttggaaaagccaaagatacgcagcaggtttcccaggtgatagtacaatgcttcaaaagtttaaattcagttcccagatcgactccagacctagagcaagactattgtgattctgatgaagaggaagatttgatcgtggatttaacgacagggtcgttaaagcccaggaatttgaagaattatctacttatgaatgaggtaatgaatggcctagagagcctatgacgctatggtattaaagccaataagggggtttcacatctactttattgtgtctaccgaagatttgcataccagagagatgcatcttttaatgcctttactgcctggctttatctctcattttattttcatttctttcgactatatagaacatatatactttttgggtaatttaacagacggaattcattatatataacatattggaattaagtgtttcaaacagggagccaactcagaattgcattagcagctgttcccttgtgctcaagtaattactgctacatcacaatcccccaaaactacgtatcactacgtacgctatgtcacttaatacgattttaggtcatccctcacctctgaaaatttctttatccttgaagtaaacaactaattgatgataaagaactaacgttttctaagttgatgcaagcaatgtttcggcttatatgatttgtcgtatttgtctttcagtcatactatcagcaactgagaccaataaaagtattcatacagtgcgtaaagtgggaaatttttttatagatcgttaattgattagtgtgtttcttctttcacaatcagagaacaaggacactcactcatctttaaattatttctcagaaaaataccattgaaccaaaacgctacgactttggtattatctacttagagattacttgtgtcattgaaggacatattattttattcctagtcagctttttcatcaattgtcacctcacttgatttcctgacccactgatgtttggtgcttctcgaccggcatttggacagacgagtacttctccttttggccaacaaactcagtcaacaaccaatgcgttcggtcaacagcatagtggaaccacaaacaatctgtttggatccagctctgccaacaacgcgcaatcagggtttggtgggtttggtaccggcggcgctaatacaaaccctacgcaaactataaattccccattcggtatgtcacaacagcaaaatacaactacttctccgtttggcggggcagcagcaggagcagcagcaggtaattcattgtcgaacccaccatccctgtttggtggtagccaatctagtggtacagcgacaggcgttctctcttctggacctccttctggcactggaatcaagccattccaaccttatacggaaaaggatgtgtcaactggatatccatcggtgtttcaatctattacttgtatgcctgaatatagcctttattcgtttgaagagttgaggttccaagattatcaacaaaataggaaatttagcaccactgctggaggtccgacagcttctgctattgcttcgccattcggtcaacaacagacaaatggtactaacaacacttttggtttaggaaataaaaataccatcagtgcaggtggcgcaactccctttggtcaacagcctgcaaattcaccttttggccagcaacagcctgtaaatgcattttcacaacctaataacactccctttggccaaccacagcagcaacagcaaactggcatgtttggacaacagcagaataattctccattcgggcaaaatactgcttcaagttcttctccattcggtttaaacaaaccggctacctctggaggtctgtttggacaaaacaccaccaataataattccgcatttggtcaagccaacaactcattatttggtcaacaaaaccaacagcaaaacccaggtaacgcatttggtcaaaatactggttcaaacacctttgggagcactttcggccaaacaaacaccaacaatcaaccgggtggtttgtttggacaaaataacaccacagcggccaatactggtggactttttggtcaacaaagtaacgccaataacgcatttggtcagaataataacacctcaggtggattatttggatcaaaaccaggtggaactacaggtggcggtttattcggtcagcaagcacagaacggaccctctcctttcggtcaacaaaatgctgctaattctactccattcggtcaggtaaacaatactcaggcgggtggattgtttggacaaaacaacaccaatactggcggaggtttatttggacagcaacaaccatctaacacaaacagtacaggattattcggacaacaaagtaacgcagctagcactggcggtcctttcggacaacaaaatagcaactccatgaatcaacagggcggaggattatttggtgcgaagccaactaccggtggcctgtttggatcaaacaaccaaagtcaacaaggttcaactgggttattcggagctcaaaataaaactgtaatgggtggtagttccgcgctgtttggtcaaaataatcagcaacaacaatctggcggattgttcggacaaagtaatcaaccgtctgcaacgggggggttatttggtaatcagaaccaacaaacacagcaacctaacaccggtggtttatttggtcagcagaacaacagtatggcaaacaacaccggaggattgtttggtgcaaaaccaacaggaactactggtggattatttggccaaagtagtcagcagcagaatacatctagcggattgtttggtcaaaataacaaccagaacaacacagcaacggggggtctatttggtcaaaacaaccagcaacaaggtcaatcatcgggtagtctctttggtgccaaaccttccggcactaacgctttaggagctaccaacggcgggttattcggaggcaacacacaacagcagaatacggctactggtggtctatttggtgccaaaccagctgatagtgcgtcaacatctggtggccttttcggcactaaaccaacaggtggtttgagtagtaccactggaggtggattattcggtggaaaacctgccggaactgcaccttttggcgcaacaaacacgaacaatgcctcatcaattggtggcggaagtttattttctgcgaataagccagcaaatactggttcgacaggattatttggatcacaaaacaacacttctggtaatgcaaatacaggtggtttattctcttcatcttccttgcaacaaaaccaacaaatgcaaaaccagcagcaagcagcacaagcgaactccaatccatatggtacggatgagctattctcccgtgttatctctattcctaattccattactcaaccaactaagcctagtgccacaatggtttctgcagacttgaagaaaaagaactccctctccgcagcatacaagctgcttccaaaacccttgtttgactctaaaaagtcggaaccgaactccagaaaggttaaaattcatctaaaactatcaaaacccaaggaggaagacactagttcgactgctctaacaagaaagcctatggattcttcaattttcactgcatctactgatgaggctattttaactaccggagaactcctctttaatccagacaaaaagtctttcaaaaaccttatcatcaatcgccaaaagatggaagaagatgatacctcatctggtgaattgaaattcataatcttcaatactgacgacggaccacaaaagaaaatggaacagaaagagaataatgatatttttagcaaaatccaagaaacacctgtttccaagcatcctgatctttctcccgagagagaaacttccatcattatcgatacggataaaaaacgtaaagttttccataaaagcaagttagtggaggatgacatttcatttactgaaaatggttattacatatccccctcctttgaaaccctagaatctctaactttaatggacgctcgcaaggtcgaaaaccttgttattggtcatgatgattatggaaagattgaatttttgaagccagtagatttatctttaattccactaccttcgctatgtggtaaacttgtaatcttcgaaaatagatgttgcaccgtctcgtatattggtgataaaccagaaaaaggtcaaggtttgaatctccctgcaaaaatcacattggttggttgttaccctaaagataaatcctccggaaagccaatcaaagatccgactcatccgatattgaaaaaacatatagagaatttgaaatcaatgaaagaggcccaatttgaatcctatgatcctgaaacaggttcctggtgctttgttactgaagaacctgttgtatgaatagcacacttcaatcttgtagattacatcatcatattacatcttatatatatatatatatatactagttttaggctgcagttgaaaaaatattttcgaaagaatcacaataacacatggaaattgcattgtcacggtggaatatgtgaatggatattaggtgaggtataatgcggtgttgatattaagatcaacatactaattcttctgaagatcaatacaaaacaataaaaataatagatgccacctccaggaatcgaacctgggtttcatcggccacaacgatgtgtaataacccctatactaagatggcgcaggatacaagatttgttgtgatatgctttggatgatactgattgattaattgttgaaacggatcataaactatgatcgggtaactaccaatgtaataggcggttaagtaccaagatgatacgtaaggattgtttctagttgatacatcatcaaccaatctgagttattatataaggaggcattggatctgtacaatgacgatcaacacagtcatgccagatcaccaggtgcatcaacatacattactagatatatagctaataaacactatggattcatcagataccaaagatcttgaaataacaacacgtgactggaaataccagtatcaacaacattaatcgcctgatgagggatcgtagagaccaaacaagtactgaatttgatataagaatatacatagttagatccttgagcatatgcgtcttgctccttcttgttgcatccaacctctcaaaaggttgcaacttaactcagccctaatactcaactcatactcagttgtccgtcggactttttcatggtaactgatagtctcatgagccactcgtcatgcgcagcttctgcctattccaatttcactaaatattgtcacgtgaccctctttgatccatctaggccttcccttctggataccacaggatccatatgcccagtcactgacgtcttggaactctgccgagcgttggatagctcacatgacctacaggatgcctggcttaagcctatcttacgacacaaaccataagaatcttacaccaaatgcagtgacacaatttcacgaggtggatactgccccgcctcctcgtggcacctcgcctcccctcaggaatcaagccgtcatgtgttgaatagccatgaacccatatctcaagaagacgccatggtaaattccattatgaaatatgtttattgagtgagtcttcgataaaaccatacttgtgtttccttttgagtaaagtaagtgcaatatatcttgagtcgacgtaacgcagaagaatatgtattgatggagatgactccagtgaatgtccctctcatttaaacgtctttctgatacgtttatcagtcatctgttgagtgacctccagaagagaattgaaagtagttcattatttttttttacatattctccttaccacgctgcagtgcataaccactatattatggagaagagcacaaccaaggccacccgaaatataaacagtcaaatatgctaaaagcttaattaatcaagtcggaaagcgtggctgatatacaagctacgttgttaaaactctttaaaatgaagaccactacccagctgcagtgacttggggtgactctggattgggctcatttttatcaggctctggtttgattatctgtgcatctgaagaccatgatgaagtatcaaattggaatggatgatcaaaaatttcttcgtatgcttccaaaaacttacccaaaacatttgattcttgaagagcttgctttttcaaattgagaagaacccgatagtttaataggaactctggatttgataaaaacattgtccataattcgttatgctttcctttcaaagagagacacatggctagttcatccgaaattaaatgaattaagtctggatcatcgtttttatccaaaatatattctataagcattttgttagcagcagacaatctgtctttcaactctaatttcaaatcattatggatctcaagattttttttggtaattagctttgtcgcaaaaggtgggtgggaatctaattctaagtcctggggccctaaccccacaatcttccaatcgacatcatcttcgtaatgatatataactggcttagtttttgcttttggtaggacagctttagtactttttttcgttgcagctttggccttacctttggttgtgacctttgaccttgactttggtactgaggggctttcttcatccaggtcttccgagatgtcactctcatcaataatatctgtgtctctatgtttatccttatttttatcatcatctgttgttttcgtattagatcttgttgaccttcttggggctggtttcggcttctttgccttcgtcctagaactgcttcgagttggtctcctcttcgaacttccctcagagtcaacattttccacgtaatcatcttcgtcttcgtcattttcgccttctgtgtagtcatcatcatctggtttcccactggatccatactccacaaactcccacacgtcaataccggtagtcaaaccttgtttagccatttcataggcatggaccaaatttttcgaagtcttactgttaactttagataagaaagcctcgatctgtggtagtgtcaactcatgcaaattacgtgggtttaaccaaatgtaggaatcatcatgaaaaaacttcacgcaataattggttaactcacgagtaaatttcttaaaagtaagcacaggtgaatattcaatattctcagcactatctgaatcttggtctgattcatctggaagcttggatctatttttcgtaagaatttgctgaggtattatctcaaacggtataaccatcgctggccatggtggataaccttttacttttgcaattacaatatccgtaggttgcaacatttttgacaccattatgaaatgcacagttttcgctattgaagtatacctagcagatacttgaaacaccaagggttgaatacctagatattccacaatccttaaagaaatcgcatttcacagtagcagttaagtaacctgaaatttacgatttcgtgtttaaaaatcattgaaaataaagcttctaaggcaaaaacattatatcacatgcaaatagccaagcaataatgaaccttaccatccaagactgattatttgctacgctaaccataagaatagtaaaccttaatttataactgaaataagttttagtatacaccagcgaagaaaagaaaatgtacaaatacatatatatatatagaactgtcacaaacgataattcttctcggagaaaacctacaaacgataggagaaaagggtccagaggaaacgggttatttattaagaaaataggaagagagaagaattaggcatagagataatgatatagtaaaaggaaagcttgtccttcaaagtcttatatcatttctgagagtccatagaatgtaaaaaaaaattaataaaaggaaaaggaaaagggttaaaaagtcaagtggtatgagagtttttcatcagttgcgcttggataattaaaatttgtacagcctctgatagccaggaaatgtgtaagagtcacagatctctgacatgtcgtatcggtagtaattgaattaaacttaaagtcaatttgtattgtatcctatttctatttcatttgagtttagtttagtttcgtctccgccctgcacgcttctttgatctttcaattcaaccagagaatcgggagatcgacggccgatctacaattcgaacattttcgatgacaagtcatcaaggaaagagaaggtggatacagatatcttgaacagttgtttctagtgccactgaaccagtcaatttgagaataataagatccaggaaggaaagtagtagaaaaaaaggatgtaaaaaaacagttagctcacaacacgtagacaggcataaattaactgataacaacaacgaaaatataacagaacaaaagtttgcttcaaagtagttaattagattcatatggttttcagctcttttcatgtctttctgtgccatttctttgaagtggtcagtgtttcacagaattccagttaagaaatcccttaagttcaaaactggccatgttgagagttaacgccgttgaagtattgttcgtaggcggcagcatggtctgggtttaaataagaagcattagtgaaattcggagtttggcccgtgccttgaacctgaggttgctggtgctgtacggattggggttgttgttgctgttgtgaattttggccctgctgttggagcgccaaacgttgttgctgttgctgttgttgctgttgttgctgctgctgctgctgctgttgttgttgctggggcagaaggccgtgggaatgtccaccacctggcaattggaccgaggtaggtactgtggagtgtggctgaccaccaacatcgccgccatgatcgtgttgcacgttatgttcatcatcttcatcttcatcttcctcctcatcgtcatcatcctcatcgtcttcctctggtgcattcaaacacgcttgaattaaattcttgccctcaggttgtgtaacaatgggttggaactttggtgtagtgaacgtataaactagaccggtttcagaaacaaccaaaagaagaacctgagtacctgttaacacagataactcatatgccttcttcataataccatgtttccgcttcgaaaaggtgatatgacgcctggtcttatcctgaatgaatttgatctcaatttttctcctttccttggtttctttcgtgacactgtcgtctttaacttctgaatccgacatcacgggcacttgcagctgattttttttttgtttcggtactttctaaatgagaaacactgtttatacctgttttgttatttccacagtctgattattctataattgagagaaaaaatatatcaacagtacaagtactagtgcgacctgggaatggtaagtggaagtatctaattaacttaatgaggttactaaataacaaaaacttttcaatgctgtgcacttccctaaacagtaaaacacctgtgtaaactatcaggcaaaaacaccaactctatattctttgttctttattctataattctttattcttgcgagaaaaaaaaacgcacacatatacagactaagcgagataaacagtagaagtcagtatttttaagcagcgaaaaatataaaaaaattatggagctaactgtaaataaagagagggagagagatattatgctcaaacacaaggacacattttcttatgaccagtggattatctggaggtaaagtttagttggctctcaaatgtactatggtgatgatgtactatgtatcaaagtttcgtcaactgcagaagttggtttttttctcttcaaggagattctgagtataatgttaccgtagatatagatgtagatgacacctttttcttaggtacagcaggatactagggattccttttgttgacaaggtgttaattgcatcccgccgctataggacacatctacgacgatcaacgatatatgtggcgagtgtttaggcacttacttatccttattatattcttctgttgccttaccattcatagcattgtcaatatccggacgtagtgttttgagaactggccggacctccttttcgactgtgtgtcgtgtagaattactcaaaagaggcataatatgagataagggagtgattagtgaagagcagagaccaaaatgtcacagtgtacgttacacgtgacaccaggcgcctcataaaagttacccggatatcgtccaattcagtacagagtaaaacgacgcgtgtggtgtgtgggtgatggtacatggggttatggtggtgccaccaataccacgactattgcttatctaagcataaaaatcagcagagattttcgctgttctataataagccataggaaggaacattaggagaaatagggacaccgtagatgatattggggtttggaattatcgggaaatatgtacagaaaacaggaaagtgtttctattactttccgtatgcgggtgattgtcatactttctggagtccccagccggtaccacattttgattgttatctcacaccattggaagaggatatacttccacaagataaacagtggaaatcagagaatagctgaaaatatggtgagatttccatttcaattggtatgatttgaattcaatctatacttggaataccggcaaataataattatacgctgataccccagggacgtgcaaagtatcatcacttttcagatgcaactccaaaaggaatgactatataaagactgattatatatgccgttaaattcttcttgaaaccttagcgctttcccttcttttgtacctgttaatcgtatatcctaatttcccttcaaaactgtcccaagctacaatcaggacaacaaactgtttactgtcgcatcacttcacacaggacaaataataatcaatatactacaatgaacccaactttagttagagctttccacagatccgccgtcagactatcccaagcttctgcggacgcttcttcacacagtatgtctaccggaaagtggtttgctaccctaggaggtgtcactgtactacttggtgctggtgctggtgccttgcaatgggcctacaaagattcaaaaattgaccaaatctttgccaaggaaagaagacagggtctacaccattgaagcaaaaattgaccaaaagcttgctgaacgtcggactcgtgcggttaaatactgagatttttatatattcttcaattttgtactaatttaatgaacggttattaaacataccctacccaggtagcgccagttttatttttttttatttattctgtcgttactttgttcttcgttatggaaaactgacgcacctgtcggtttaatctttttttttttttatgattggtacttttacattgctttggttctattttttgatcttcgatactttttttttaaggtactatttaagaacacagttacatattcgacaaactttaatcagtcaaagcaacggtaaaattaggattcttttcagtggttggttgtctcatcgaatatttgaattataattggaggtaccaaattgtaatcagaaactttaaaatgtcaatctatttctctgtgttgttcatacttcttgtggcccaaatggctttcatgttcatgatagttatgcccttgcattatcagataaggaaaagattagtggttttctctgataattttttatcaggtcctcaatttagaactgtggtggctatattaagttgtttagtgatgctactgttcattgactcatggaaacgtgcacagctcccagtgttctctcacgcagagaaaccacaagatgtggctagttcgttgaagacattgactacaagggcttacaatcaaagaaacgtatacatttcggggttcattctatactttactatttgtattcctgtcttattgaacttattaacccgtttggtaaaatacgagactctaattagggaactgaactctgtacctgcagttgaaaacaagcaagatgagaaggataagaacaaagccaaggagaaagaagtcgcatctccccaattaaccgcactacaaaaggagttggaatcaaagaaagtatctttgaaggcgttaaagattcaaataaacaatctaaacgaacacttcgatgccactattaaggataaggatcctcagccagcctcagagaagaaaaacgattgatatgaaacaatgtacgaacttttacttaactataaagcacgaaacaaaaaaatccattattaacgaccacgaataccggattcccatgtcgaattcatcaattctttgaaaatgctttcttggacatgtgtcactaattgattctcttctgtagttaacccatcattatctataacctctttataatttcttaaggcatgttctacttcaacgacgttactgcatcccagaactgtaggtccgcggttcaaccattggaagatggcatactttgttgccaggtcagcaatttcaacgccctctttcaacaggtacttggcggcctcactactcctatgacgtagttcctgtgagcatggatggaaagacttagtttcaccactggtcaatagagacattgaaaggatggatccgttggcaacggttttcacttgacattcttcgatgaatttatcgtaatactgctctagtataagattttgtaagttgaggttacaatacgataaaatgttgtccaatgaaccaatgcgtttgatatccttacatttcttagcaatttgatataagaaatcgacagggtacccactgataccaattctcaagacgattccttcatctttcaactttctcatttcagtgagagcctccaagatcatatcctcttcgacaaactcaatgtcatgtagatataacacatccaagtaatttgtcttcaacctttcacatgatctcaaaacactgcttctcacatgctccttcgagtaatcaaagtcatcaagttgaattctaccaactttggtgcatatttggtacgagttccttggccattgttcctgaatagattccaacgcttcaccatatattatctcactgggaccatagtatggtgatgtatcaatagcgttgattccattagcgaaggcgaactttagcatatcaacaacgggaatcgagtatggattatcattgtattgagtatttaaagttgctcctcctaaaaccagctgtggtaatccaccgaacctctcaacctgcttaacgaccatctttaatttcacgggtatgacaggtcgatgctaaagtataaattgtatctatatataggtctgacctacttcaatgttatcaattaccaggcgcatgccagttaaattcgatttctattcgaaacctgcagttcgctcaaccacagttttacctttttctcagatttctttcttttcttgaatgtcaacatgggataaaacgaaaactggttagaagtattatcatcagaacaaacaacacacaaaagttttcatgagtgatggaacgaatgaacggtattagataaaaattaatatttgagagtgttcggtggattgttacttatgtgagtgtatatctattttgtatttctatagagaccagtttgtttttatctcagttgagcagtttagaaattactattggaggcaaagatttgagctagagcaatcacaagactcaaaagttcttccaacagcagcaaacagtttctattgtgattagcataatcagcagacaaagttgtgtattcaagagatagtagtggtaaaatttactaggagaaacattgcccagcatgccattcaaaagaagaattgacagtatcatgagcaatgatcgaggctttgaacttggtaagaacaagagagtaacgattcgtcgtttcaaaaatatcaatttgattgatattcgtgagtactatctggaccaatcgtctggagacatgagacctggtaagaaaggtatatcgctaacggaggagcagtacgatcaattgattaggcacagaagtgaaatcgagaactgtttgattgatttagggtcttctagatccttaacggatagaccagagatggattcgttacttgagaagaagcagaagaaggacaagctcaagaaggagaaggagaaggagaaggaaaaggaaagggaaaagctgaagaaagaaaaggagctgcaaagagaaaaggaggatcgagctaatactatgggtggaattgtcgtacccacaaacgtgaacgctgtgaaagaagaacaacaggacgatgcatctgatgacgcaaacatcaaagatgaagatgaggcacagttcgagacagtgaacaccgattctatagccactacgacaagagcttccacctctgccagcagcaatccaagactggatgatcatctggggaaactgcctcgttcagcacctgctgtagaagaagaagatggcgataatactatggaaagcgatctggccaaggcattgtcacaggaccctcaaaacggtcactcagatgaagatatctccgaagctgattagattaaatcagacgagattccgaaagtgctttcctctttttttaccattcttaagcctacgatctttacataaatatataccactaagtatatgcacacttgcttaatttcttatttacttgtttggcagtctacacgtttagaaggttgatgctattgtcatcagttacccggacgaagctcctcttctagatcgaaagcggaaagctatagcaaagaaaagaaaaatatatcaaacctaaatcaaactgtttatttctgaaagatcaaactacctgataatttcatttcagataatatgaattaaatggaaaggaaagtcaatggcatagaacgtttctgtttgagtgtgtatctatcaatattccaattttgatttatcaggcatgctagcaagagtgtaaggagaaggattttacactagcacgctcttttcggtttaattgtgagagttaacgtttgattttccatttatatcaagaaattcaaggacccttaaaacacaccactctcattttagtagattgataacggcgtgatgccagataaaaaggatcaggtgcccttactaggctctccggagacgaaagctaagcggaccaggagacgttccgtgtttcagaatgcagatgtacagtctccttaccgggtgaaagtcgataaatccgattcgatgggattgttacacgatacagatgacgacgaggatgagacagaagaaaacgtctttcaaacgtcaaattcaagaaagtctcatggttcttatgagtcccagttttcaggatcatacatcgatcataggccatctcttgccgttttggatcaatcatcgtcttctatgaaaaagaagccctcaagaccttcttttagtgatccgttcaatcaaggatctgcaagcagaaaaacccaatcgacctccaaagttatatcatctcagggttcgggagcaagaaggagaccttctaatattgggcctcattccacgccactcaatagatcaacctcggcagggaactatggctcgttgaataatcgaaatgatgtggttatcgatatggatgcgttaatggagcatgttaataggaaaaacagatcaccttcaagtttaacttcaagaccaagctctgtatcgaagggttcgtctgaagacgagtacaattcacagccttcttctcgaggaacaagcgattcgagttctttggatgacgtttgtctaccaatagatgacgaaacagaagaaggttctaaagtttggcctgatgtgtcggttttggaagaattttcacaagaagagatagaaagattaagaagagaagcgataagggatacggagaattttcatttccagtatgatgaggacgattttgaccatgattactcggatgaggaaaggttggtctcatttggagctcaaaatactggcaacttagattcacaacagggtcaagccaacggtctaacttttacgaggccaataataaccaatattgacgtcccagagctaggaaatactagggtcaacgagacagaacatttgaagaatgggaggctaagaccaaagaagttgacaccatggcatttaaagcggggtaatcttaacctacctgggctttctagtgctgcaatctcgaaccaagcccccggtaacgctaaacagccacatggatcaaattccaaggctgcatctgttaggtcaaattcaaagtttagtgaaagcaggccttttacggattctagaagaaatgatctccttgttggaaggaatattcagtatcccccacacattatatcaaataatccagaaattttcaggttcacatactttagagaagacttggattcaactattcactctcctacaatttcgggattgttgcaacccggtcaaaaatttgacgaattgttcgttggatcagtttatggccatcaagcaatgtcctctaatgctgatacaagagaggtcactccaggagcaggcatcagtacaggtgttgcgaatcttacaagctcaactttacccccaaaaaactctgctccatcgactttggactttgatgatgtgagtccattttggcttgatgttcttaaccccacggaagaagaaatgaaggttttgagtaaagctttcggtattcatcctttgactactgaagatatcttcttaggtgaggttcgtgaaaaggttgagctctttaaagattattatttggtttgttttagaagttttgatattgtcgctgaaagacacatcaggaggaagaaacaacaacagcaacaaaaacaatcagattccgaatccagtgactctgatgatggatccccacaaggcggttggattaaaaatttgttcaagagaaaacgcaggtcgtctgcgtgcaaaacgatcagctcttccaactctagtgttaagagaaaggcgagaaaggagaaagaagaaattgaaaagtataagcggaaatctggtgatcgtcgaaagcctcgtgcaggtgaattagaaccactaaatgtgtatattctagtgtttcggactggagtgctcactttccattttgctccaacgcctcatcccatcaacgttagaagaagagcaagattgttaaaagattatttgaatgttacagcagattggattgcgtacgctttaatcgatgatatcaccgatgcttttgcacctatgatcgagctcatagaggatgaagtgtatgatatcgaagatgccatattaaacatgcatcacaccactgattcaagtgactcggattcaggatcggattcagaatctgactcggatgacgatgataatagcctgtatcattttgatagagcttcgaaaaataccacattctcgagactaactaagggcagttcgtcaactgcaagtacaagatcctcctcctcatcttcttcaacgttgaatgccaagaacattattggttggaagaagaagggtgatatgttaagaagaataggggaatgccgcaagaaagtcatgggtatagttcgtctattaggatccaaagctgatgtgatcaaaggtttcgccaaaagatgtaatgaacaatgggaagttgcacccaggtcagagatcgggatgtatttgggtgatattcaagatcatatcattacaatggtatcttctctaaatcactacgaaaaactcttgagcagatctcattcgaattatttggcccaaatcaacatcgatatgacaaaagtcaacaacgacatgaatgatgtcctaggcaaaatcactatattgggtaccgtcgtgttgcccatgaatatcataacaggtttatggggtatgaacgtgcttgttcctggtcagggaacaaattctttaacgtggtttgtgtcaattgcttccttcatggttgtcgcagcatattttgcatacatatataccaagaaaaggtttggtttctgattatctccgcaacaccggtgacgaacctctgcactgtgattataataatgcctgatttcaatcttgtgtatttaataattacctccaactaaatagttataaaatcaattcatacacagcgaatggaacataaatagttactacaatttaccgtttacgatgactgccttaatctctatttggtgtattgtgtgtttagcatgtctccggatggctaattgtgtaaaaaaaataaaggaaagttcaagaaatttgaattactaagaaacgagcaagacttggattattaagagttagacgataaacgattcacttagaatattataaagtaacataagtgcaaatccaatcagctagaattcaaaaaataaaatgtctggtacagatgagaacgattttgaggccacatatgcagttgaaatgcattgtgagtcgtgtactaacgatatccaaaaatgcttgaaagatgtgaatggaattaagaatgtgacatttgatattaaggataatcttatgaacgtggagggccatgctgccccaagtgcaattatcaatgcgttaaaaaattgcgggcgtgatgggatcataagaggtacaggtaaaccgaatagtgctgctgtgtctatcttgggacaatacacgactggcccttttgaaaatactgtcaagggactagttagaattgtcgaggtagctcagaagaaaacgttcttcgatataaacttgaatggagttgagaagcctggtctgtattacgcctctgtgagagccagtggtgatctgagcgaaggtgtgaaaagcacaggggatccgatctataagttcgaccagcccatagattgtacttcaccaagtgattctatacctaattctttcagtggcagttctttcgtttcagcaccagtccatgtatgggaattaattggaagatcatttgttgttaccaccgatccggagcataatgtgaacaaggataatgatatttcgtttggcggtgtgatagcacgcagtgctggtatttgggaaaatgacaaagaagtatgcgcttgcagtggtaagaccctatggcaagagaggaaggatgctattcaacacaacatcagattctgagcttggtgttcctgacacacgtctctcttttttctcgtctctaagccggtttttgaaaaggcaatcaatatctttatttaatatcagtatggatatatgcgtatgtaagtgtatattgtggcagcagtaagcgagatttagtaatgataatcactccagctcagtatgcccacagatgcacgatgacggaatgcacggaagaaatttctaaatcattagttattcgtcctttttgtaaggagctgcttctttgatttcctgtgctttcttatctatacccttggtaccctgtttgtcagctttaacatcattgccaacgttgtttctcgaattttgcgaatttttagctgctactggagcactatcggatagatcttgtggtgaaactagctcatcattgaacttctctttcttctcttctttattattgctggcaactgaacccacagagccttcagtagagcctgcagcagctccaacagccactccaggagcaaccatatctttgcctgctacggaacctgccacagaacctgctttttctaaaagagcatctgccgcatccatttgagattctaacgcgtccctgttaatcccactcgatccaacggcacgatcaagctcgtattcaacatgttcatcgtctttcccaagccttatcgtttgaactattacgaaaacagtagacagaagcatcaagtagactatgatcttcttcattggcgttgtaagccatccgcccttagacctgccatggccctgtgtattatagcgaggtaacaaatcgttaccgcgacgaattcctccttgcataataataaaataagagtagttcagtaagccctaaacaagttaaatgaaacacgatagcaagaataatgcttcacaatactgattctctatacctggccacgaagtaccaacgaatgaaccgatatttcaaacccattgaacatagtcaacaatatccatagactatcaccataccaaagtacatgattagattcctttgttactttgacaaaaaaaaaaccgttctggatattcgaacgggaaaactgtgacaagaagtccaggccgattaatcatggtttgtttttgccgttcagtatgtggtgtacgaatgtatagagtgtatagtggcacataatcggatacaaaggttgcgtaggcgttgtaaactggactatcaaggttcaaccggtcatgagtccatgtaatctgccctcacaacctacagcgtcgtctttatctatggctttgtgtggcttattttttgttatgtatttacagtactaaatattgggtcgaaattctctgaattctgacttacttcagacaactgattgacttaattaaactatttaaaaatgtgattataaaataagtttttaagtgagagataacccattttgcaaaggcaaataaagggtagaggaagacggatttacttatcaattagcttggtatcattgtgataattacgatactaaataaacaaacgtactgtccggaggaaaaaaaatggctctgggtcggtatgagtctggaaaccgaggctcttatacttcagagaattcattagatataagaaacgattcggtatcgacaaattacggtgataaagttgcaactgagccaacacttggctatacacggaggaacgaaagtacgggcagcacaccgcctgctgttaggaatgttaagagggaaacgctgcaaaacaacatgggaagtacgccgacagaattgaatgacttcttggcaatgctagatgataaaacaacgtattccgaggttgttcagtcggcagaaccacggctggggtttgaggaccggcagaaatcgacggaataccatacggggtctgaattgagcgggaatagtaacggaatagctcttagtgggagtcccgtcgatagctaccctaattctcaaaagatttctaatcatagctcaaggaacaatacactgaactattctcccaatatagaaccctcagtaatgtctgtcggtaccctgtcgccgcaggtggccgatataagctccaggaaaaactctaccgttggtaactcgttaaattcgaactctatacaggagtttttgaaccaaattgatctgagtcattccgaagaacagtatattaatccctacttactcaacaaggagtcctactctacaaacaataatacaaacaatggacataatagctttgaagttacacattccgattcgttgtttatggacagtggtgctgatgctgaagccgaagatcatggagagttgaaccaacttaatgaaaatccgttgctattggacgacgtgacagtatcaccaaaccctacctcagacgatagaagacggatgagtgaggttgtaaacggcaatatagcataccctgcacattcaagaggttctatttctcaccaggtggacttttggaatttgggttcaggtaatcctatttcctctaaccaaaaccaaagtagtaattctcaagttcagcaagataacaattcggagttgtttgacttaatgagtttcaaaaataagggaagacaacatctgcaacagcaactgcaacaacagcaacaacaggctcagctgcaatcacaaatgcaccgccaacagatacaacagcgccagcagcaccagcagcaacagtcacagcaacgccatagtgcgtttaagattgataacgagctcactcaactattgaatgcttataatatgacacaatccaacctgcctagcaacggcagtaacataaacactaacaagttaaggactggttcctttacacaatcgaatgtcaagagaagcaattcatcaaatcaggaagcacataatagagttggtaagcaacgatattcaatgtcacttttggatggtaaccaagatgttatatcgaagctatatggagacatgacgcgcaatggactttcttgggaaaatgctataatatccgatgatgaagaagatccagaagatcatgaagatgctttaaggctcagaagaaaatctgcattgaataggtcaacccaagttgcatcacagaatcctacggaaacttcatcaagtggacgatttatttctccacaattgttgaacaacgatccactactagagactcaaatttccacgagccaaacttcgttaggccttgatagagctggtttgaattttaaactcaatttacccattacaaaccctgaagcccttattggatcaagccaacctgatgtccaaactcttaatgtttactctgaatcaaatgttctccccacaagtgcacagtcgacaaccacgaagaagaaacggtccagcatgtccaaatcaaagggccctaaatctacctctccgatggatgaagaagaaaagcctttcaaatgtgatcaatgtaataagaccttccgccgtagcgaacacttgaaaagacatgtacgttctgttcactcgacggaaagacctttccactgtcagttttgtgataagaagttcagtagaagcgacaatttatcacagcatttaaagacacacaagaagcacggcgatataactgagctacccccaccgagaagagtcacgaattcttcaaacaagcactgaaataatctacgatatttcagatgtgacattggaaatgagatacaatagacatttgataattggaaatgaatcatttcacagttagttatgaattctcaacttttttaatagtcctttatatttttataaggaagttcatttatatacaccccggataatccgatatggtctaatatatgcgctcacatggatcctttaataaaatgtggtgtacacgttcacttatcaccaaatgtcgtctgcatatgtgtattccctttctttggcatatttcttccattgaattttcaaaaagcctgttttcatgtacagaataatcatattcaacgtaaatgctgcatacacatgagaagataaccataaaggatgaagaacagctacaaaacgttatctggctagacaagcaatcaatttgatatgcaactactgtaagaaatatgaagaagtatcccacgatcatacagtttccggagtcaattaggattcaacctatgagtacggacccggaatcatactttcaaattatcgatgagcaacaaaagaaactagaacttggcgttataagcaagacaaagataatagaaaggtacgtttcggcttcagattcagattcagattctcaagaagagcacgcacagaaatttgtgaaccagtaccgcataggagaaagattgggttgtggacagttcggtactgtttacaaaggtcacacaacaggaaaagttgtagctatcaaacagatctataagaaacctatgaattcccccttttctatgagcctaataatgaaaacaatgaagaggtacgaatccatatctggtgatgtacttatcatggaaatgaacgtgagtaaaatacgatgggaatgtttcgttacgagtaaactaaatcaccctaacgtaattcaattattagaatgtttggactctccttattctgaccaaatatggcttatccaacccctcgcagtccttggcgagttacaatggtctagagaaagtaagtttgatctgatagagcaatggaagtcattctaccggggtcaacttgattcagtagaggagttcgcagtgaaagtgttaggagatatatcaaatggtttacagtacttacaaggacaaggcattattcacagagatctaaaaccgcagaacatactattagatccagtatatcatagcttaaggatctcagatttcggatgctcattaatcgtaccgagcaaactcccgttcaaagatggcagactacaggatttatttgaaaaagaactgaataaaatagtgggaacaccactgtttacagctcctgagctttgtaatttcgctgaagggtcagcccatgctagtaatgagcagcctttcaaaattgatgtttggtcgcttggtattacagtgtacgcaattttatacaatgtattaccgttctggggagaaactgagtttgacacatacaatctgatctgtcatcggcagttgaaacctgacgttcataacagttcaaatatttatggatggatacatgaatacgttgttaaccgtatgctatccaaaaatacagcttctaggccaacaacatcaaatattttgcgtacattggaatctcattccaaatctgaactatcatcaatgaataaaatgaagttgaagctaaataaatggaaaaaaaatctactcactaagaataaaaataccgaaattcttcctacacaatccttcaaagaggatttttgttcgcctgccagtagtatcaatgctgcttcgatccctcttacagacaagaaacaaccattgaatcgatcccatagagcgacagttaatttggaaaagtacattaaataggtcaaattcatagattacataacctcacgcactctccggcattcacaaatagataaacccttaactttgacctgctgtacagggaacgcaacgggattcatgctgtccttttctaaccttgaattaatgtctttttcgctaaggtttcattttgtttacaattgaaaaccctactatttacgtttcgcaaaatggcattattaggaaaaaaaagtttctgtttttgtttcactctgtgcggtgataaacctcaagatctggaggttttaaatagaattgatcaaaaagtcaaaaagacattagcgcctgtcgtattcctgtgatcagcgctagtcatcgactggtaaactgaaagaaggctactcattaattttactgattttgtctcaatagaaactatttgcgtagacttttcttcagtccgcttgtgaggttctaatcaccagatttaattaccgacttaaagacccacctttctcaacattgaaccgggcatacccagaagttgaactatcaatatactcctgaacacttaaccgtcccaacaggcatttcatttctcatattattctgtttttcctttttcctttttgcattcaaagatcagaattcaggtttatattcacctcccgctcttaactataaggtacctagttgcctactccatttacgacattaaagtattattcaactcagacttgaagcatatctgcaaagatcattctgcattgtttctcatatatgtttaattgtcagatcgttctatcgtaaagcaatgaataactctttcgagaataaaaagccgacacggctcttcaagcacctacactcaatatggtccatatctcttcgagggaaatctgataaagaagcatatactcaaaagaggtctgttacatcggaatccaaaaggcctatagcctttcaaggcgagatatcctccactgatagaaaaatggtcaagttggcggacttcaaacaacaaacactgattgttagcgaaagcgactcgtcaatatcaatttgccaatcgccattaagtccgatgaatctgagaagagagaactcgctttccctgatgtctccaaatagagacactgaagagtcttccaattatgaaaattctaatgacgagtctgagatcgaatcgcttaatacacatgaaaagtccgataagatgccctatgataatatgatgctcaacaacaacgaatcacaaaacacgcttttatgcgattataatcccaaaatgtcgtcaaaagctgtgcgacagaggagtttcaaaagacgcgatttggcacccactattttaacccaaaaagccaagctcagacgaacacattctatgtttaccagtacgaatgaggtagaaatcagaaatacacgtattccaatttatgactcacgtttagaaatttcaaaactaccaattcactacgaagaacatagcagtgataatctaccgaggataacagtggagactttacttcaaattatgaatgatgattatagcaagttctatcaagaagtctatattgttgactgcaggtttcagtacgagttcctcggtggacacattaaagatgcaattaatatatcgaagcaaaagcaattagaagaagagtttattcataaaagacacatcagatgttgtgacagtgaaaggccgccattaatcgtcttccattgcgagtttagctcctatagaggtcctataatggcatcacatttgagaacctgtgatagaataataaatcatgacaactatccgaaacttcatttccctgacgttgtcgtactagatggtggtttcaaaacattttatgagaaatacccaaataaatgcgagggtcattatgtctgcatggattcaaaaaatcatgaattagaattgagtgagtttaaaagagatagtaagaagctaatgactcgagcaaactcaactcaaatattccagttgaaagacaaaattggaacctgtcctgtaagtttgagcgatgtaaacaacgattataatatcccactccccaacaaagttactacagaagaacatcaactgaccaatgaacaaaacatcgactatgatgaagaggcatcatatttcaatttcagcataaacgtgccgcccaaattgtgcctagacagatatggcgaaggttctcccaacaatggattaaattcatcaaagagtagcagcctaagtacaagtagcaggctattattctcagatgaaatagggactgagtttaaaccaaaatttctggagcacgaagagtctgatttagattcagatggatatagtttccagtttggtgatgacgatactgacgatagaatgagtaacatcactgggaagaaacgattattcccggaattagtcaatgcgaataaataaacaaggtacaacgataaaataagaattgaattgaaatccataatctcatcatttcattatgtgcatgcttaatatggtatatatacataaataacaacaaattctttctctcttcaggtattcggtctttacgtcacgaatgttccatcgtagggaaaactttaatgtcacctcttccttcgctcatgttcagatctgcgctccatctcgaagggggccatactattttgactgctttacctaatgctaagccagtactgatggggccgaaattgttagagtcaactgaatggtatacattatcaccttcgacccatagatgatttctgggaatcagacaggtatccttaggataaggtgatctagttttcacctgatcaaactgtacgcctttaacacgtttacagtatactttctttggattcgaaggggatttgaatagtactacatcattttctttccaattcttggcttgtttgagattaaacttccaaagaagaacccaatcggattcattattgaacgaatcagttggattaagcgtaggtcgcatcgaggagccttcaatcttagctacatagcatacatgttctgtgaaggtgagtataactggaatccacgaaactgtaataaccgcagatcgcagtgcatagcttccataattgaccattttaccaatgagttattacagggacgtacaacgatgaagtcgcaatgcgataaattcttaatgcagccggttggggtagggaattcttcagtttacctcattttttgtcttaggatgcatatcttacagatccatcaaatattgacgtctaattatctgttgattctcgtattcatactgaaatatcccagtaatgcttgagaaaattcaccggaaatataaatcacgtgacatgataggacagtcctttttcgctgatgagagagaaaaatagagcagtggatcaatgcatataaatcaccggttgaatggacaaacgaagacagcatttggcgtaatatttatcggattaatcttgcactgtgaatagagcgattttcagattgccaaggcaccgtaataggaaccacagtaatggattaatagcatcctcttttttttttgatttcgttacaggccgaatgttagcacactaacctcacctggcttccagttgcagttctcaatttcaagataaaaccccacgctacggttcaatgtcttgacagcttccaatcttgttattgtttccgacaaaccaaacctaatgcagcaaacggtatcctagattgtcgttgatttctcgtccacagtccttcaactggttgaaaagttgcggtttagaggaggatgcctgtactatgtagtgtatgggtgaaatgacgaaaaattgaaattaatggaagcccagtcacgtgagtcccggagacattaggtgtttaaatgcgcagagttgtaggtaaggctctcctatcagcgcgaaatgaacgatataaggatgtttgttacaatactttgagaagttatatctcgtttggtcatcaaaaaccgtagctgtgacgccggttgtatctctttgtggatgagtccgagatgctctaatcggttgtcattatgtcctggaaaaacggctgaaaaaaaaaaaccagaaaactagaaggataagaaaagtcattatttgactaggatttattattttacatctatatatatatatatatatatatatatatatatatatgcactgcagaataaggacaatgaacagaacgaacgatcttggcttacggcagcttttagattgtaaatgttagttagtggcacagacaactatcgtttaaggttatacattagcttataatatatgttttcaagatcccaagataaattttgctaacatatcagtattaagctcggactttcaacattgtttactgaactgaaacaaagcagacaacaccagagttttggcatttatttcagaaatagctatgacagaaagtgataacatagcggatagagtttcatctgatagttcgctgtcggttgaaagtgaacaaagaaagaacacatcgccgttcaaacaccgactctccgtcatttataaccataaaatcacacagtatatcatatcacaatggtttttcattgggttagccatatttattgtacttgcgcggttcttccctaattttgctaggagtggtggtcttattagaggtcaatattctatcggttacggtgcagtcatcgtcattttcttacaaagtgggctatccatgtcgaccaaaaaactattagtgaatatgggtaattggcgtgctcacctcgtcgtattggtgatttcatttttagtcacttcctccataatgtacgggctttgctgtgctatcaaagcagcaaatgatgataaaatcgatgactgggtacttatcggtataatagtaacggcaacatgtccgacaaccgtgtcgtcgaatgtggtgatgacgacaaaggctgatggtaatgcattactatgtttatgtgaggtgtttattggtaacgttttgggtgcctttatcactccagcactagttcaaatgtatacctcttctggaccaatggttttcggtaatccagcaacagatacttccgtgcaacagttatatgcaaatgtcatgaaacagatcgggttatctgtctttatcccgttgtttgttggccaagtattacaaaatgttttccccaagcaggtgacgtggttcttgacgacatttaggatgaataaagttggatctttctgtttgctcttgattatgttctcgtctttctcaacagcattctatcaacatgccttcacctctgtctctcacgcttgcatcatctttttgtgcttcttcaatgtcggaatatacttattctttacccttgtatgtttcgtatgtgccagaccgtggtttataataaaaatatttgaccacgaaccaacagaacactcatcgaaaacttatactatttgctataagatcttcaggccattttactatagtaaaagagacgcaattgctgtcatgttatgtggcgccgctaagaccgccgcattaggtgtctctctaatatcctcccaatacggagatgataatccaaaattaggtacattattagtgccattggttttataccaaagtgaacaggttattactgccaatttcatggtccctttcatgaagaaatgggcatcggatgaagatgaacatggtaacaaaatcatcaagcaaccgaccgacgaagaaagtcgaatttctcaaaacaaagaagacgtttctaaagagaacactgaggacgctgactcccgtgactaattttaatatttaagtgttgtccaaatttttttttactcgtttgcttaactcttcctaattgtcaaatataaagcatttcaggtatagcttcttttttttttctcattgtgcatttgatattcatcaactaccgatttcaataatattcaagtaacagttcacacctatgtaataaagtaattattccaattcgttggatacttttttcatgaaagtgaaaatattttactctgttagatattatttcattggacattatacaatttgaaaagaatctatagtctggacgtaaccaatgagcttttgttactttgttcatatcatcagttatcaccactgtaatcaccactattatctccactgccgttctcactgtcatcttcatcatcgaaaatctcttcaacagtgatatcatacgacaaagattcgaaatatttgtggatactctccactttgcttgggtgacatgctacaaatatagaacctcgagcaggatcaaaaatcttaatatacacatctgtcatagcgtttttcaaatcatctgccgttactttctctagtttcttcaagatttcggtgttaaaatcgggccctctctttttgcagaatgtattcaaatatttgtttatggcgacattgaaatagttggattcattacttgcaatcgtgtttatgatgctgctgattgctgctttgattaaaataggttcgaatatcttttctcctccagcgtaatcagtgactatttgcttacctgcttcataacacgcaactgcatccgaagcacggtagacgttaaaacccaccatattagactcgaacatttttgttaagtaagctccgtatgctaaccctgcaccacgaattcccttccagaaaggtccttcaacacattccagatatacagctgccagataaattgctggaaaatctgggtggagataatgtaaatcaccaggaagggcagtgagggcaagcatatatgaagattcggaagctggagttgaaactatgaatgccttttttattggattttttccaacttcagataaactggaggtcagcaatggtgtcagtggaacagtaacagtgacggtgggtatatttttagcctttggagcgaagtaacggctccaaggttcataaatatctcccaacctatcaatatcgccaaatactaagatatgggccttgtgaagttgttcggttaattgagttctcaatgactcaagttttggtaaaattttctggatatagtggccatcctcaatatctgtcaacactgattcaatgattggttcaacgtacaattcatcggcagatttctttaacgatccctcattgtataaatgtctattcatagaagaaaacatcatttgatcaccttcccttttagtttcaacgattgagttgtaaaacttctctaaaagaattgaaaccctgctttcatcaaatacagaatcaaataaaactcttttgagccaattcaccgctttcgagtaatttgtagctttgcattgaatcttgaagtcaattaagttggaaaaatttccaccgatccccatacttatgtcagtttcaacagtttcagtttttaactgagctaccacatcctcgaaagaaatggtttcaccattctcccctatcattggcatggaaaatagttctgttacgacatgataatatggcagtagttcacagtctttaacaaaatcaacatttaatgctacatgtatttcaacaaattgagatggaaagtgctcgaaatgaatgaaaaaagggaaagcttttggtttcaaattaatgatattatcagtcaaagggaaatcactatcattggatggaacaggaatacatgaaatactcttagtttcggtgaaataaacagagtcttgcgggttttcaatttcaaatgatcccaaaacgtcatcaggaatttgaacattgttgttgtgctgagcctgagagaggctttcttttagggcctttcttttagcgtcatcaaataacttcgctctttctttcatcctggagtcattttcattttccagtttttcattgagcttagaactaggtttcccaataacaaccactggttgatttgtaacaaaactttcttcaagcaaagcttgccatttttcctgggaccaagacaacagaatgttgaaatcttccaatgttttcaggctttcttcaagtactcccccatcggtggcaccgtaaaggaaatcggtgatagccatatgcgcaaccatggtgtcaccaattttttcaaatttgaatatgtaatcccatttcatgttttcagtgactagtctgattctatccaaagaaacatggtgggttttcaatagatcaagtgtcttttccttagcttgttgcaatctatctgttggaacacctttcaatgaaatgtttgaaattgtcctgataaaatcatcgctccaatactctgcgtcagtagcatatgggttttcgatctcaatcatttccatgttgaaaggagccagtggagattcagtgagatattccagtaaaatattaacagcctggtcttcaatatgcttcaagtatggttgggtgatccatgaaaaggacacttcgccttgagactcgtcagcttcagggaattcgattgtcttttccttcatctcagttaatgattgcggtatttgagaagccggggtatcaataaaaggtctctttctctcattcgcagtaaattctggaagctgtttatcaaaaatttccatcaattcgatcaattcttctgaaggaatgttaccagtgataatcacacagcaattatctggtgtatacatttgtttatgaaattctctaatttcatcgttcgtcaacacacgtaaatttggtgttaaaccaccagtctcggaccggtatccactaccttctggaaacaatagtctttgtttttctagtgttgtgataaaccatgattgagattcgataccagccatttcactaaacacgacacctttatcagataaatcgtctggatcgatatgatacacctcggtggtacaagcatcttctgtcaaagttggaaagaacaagtgatctaaatacactggtagaagtttcttgaaacctttccagcctgcggttgacaaagtgtaaacggtttgatcggtggcagtccaagcatttgtatttgacatgcataggtttccagcagtatcgagcaaccctttgtatgggtacttctcagatcccatgaaaatcaagtgctctaaggtgtgaggaacaccagaatctgttggacattctgttccaacggcaaagtaaccttgtactaaaggtgacgacttgttatttaagtgaactagttgaagcttggtacgagttgagatgtacttagtgaaatgatactgaggtgcatactcgacttcaaacgataccagtttcttgaaagtcatgattcgtttcaccgccgttagtgagatagaaatttcagctaatggggcccgaagtgattcgcgtagcttaggcgtgtgtttcgttcttttacagtatggttttgttaaatgcaataattaaaagattcaattaatctttaaatgttaacttttgcaatgtgacaagagtcggagacaactactaggaagaaaaacagattacgtgctacgcatgcgacaacagatcaggtattctacgattctacaactattggtgctataaatactactacgagaaattatattaattggaacacactcttcagatatctataccttgtttcttcctttaaaaatcagaagtctaacgtctgaaaaaaggattttaatcatcataagaagcgcgttactaagctttcaaataaatatccataaaacactcttattgaaggccatttcttctgaaatgggccttgtaatatgtatcttgaaaacaaacaatttcctatggaaaggtactgcatcatcacgatatttaagcaatccctacaatactccacagctctatatttctatagcacagcagaaaataactaacgcataaaacctagccgttgcattgaacccccaagacacttgtttccctaacactttaaactctgcaaattgtgagtaaaaaagaatagtgtatgttcaaacaaacttcatttttttcattatttttttcattttttgattactcgagacggtgatgagtttgaaattaattgtcaagttggtgaaaaaattctggcccttagaaacatcgtagataccagtgccattgcgcttgctgtgatcagtggtgcatatcgagaaaagacatcctaagtcacaacggcacatatgcaattctagtagctgagtaaatgtaggatttgcgtgcctaagacatgatgtcttatatttgcaaggtcttcggatcgtatttaaggctttgccttgctgtatattttctgctgtatgcgtggagaataaggtttgtctagaatcaagggaaaatacattcattagtgacgctctagaaataggtatatattgtacatatatagataagctatcagtttgcctatagtttgggaggttcctgagaagagagtatttttacaaccgaagggagaaagacggtaacagatatgactggatcgtacgaattaaaccacactggggaggtggtatcaaatagaggtcttaaggatgcatataatgaggtcactgaaatggaggtagaccctaaaaataatgagtacgctgaggagcaaagcctgaatagagaagatacgtttgatcctgatagtggtgtgaaaagacagttaaaggatagacacatctcattgttggcacttggtggtattatcggtcctggttgtttaattggtgcgggaaatgcactagcaatcggtggtcccttggcacttttgcttggatttgggatcattggaattcttgcgtttatcatgatggaatccattggtgagatgatcactctttatccatctggtggcggattcactactttgaccagaaggttccatagtgatgctctatcggcggtatgcggttacgcatatgcagtagtatttttcgctgtgttggcgaatgagtataacacattatcctcgattatgcagttctggggaccgcaggtccctttgtatggatacattttgatattctgggcggcgttccaagtcttccaattgttgggggtgggtgccttcggtgaaaccgagtattggcttgcttggtttaagattttaggtttattgacgtattatattttttccattgtctatatatcgggaggtgttaagaatcgtccagcatttggctttcagtattggaatgatccaggcgctctttctaatgggtttaaaggtattgctaatgtctttgtcttttgttcaacgttttattcaggtacggagtcggtagcattggcagctacggaatcaaaaaatcctcgcagagcggtaccgattgccatcaggcaaacattttggcgtatcttaatagtttacctcgggatttccatattctatggtgtcaccgttccatataatgacgaaaaccttaactttgccacgaaagttttgaaatctccaattgccatcgccatctcaagagcaggttggccagctggtgttcacttggtaaatgcatttattttaattacttgcatttcggcaattaatggctctttatacattggaagtaggacgttaactcaccttgccaatgaaggtttggcaccaaaattactcgcttggacggaccgtagaggtgtaccgattccagcaataactgttttcaacgcgttgggtttaatttcgttgatgaatgttagcgtcactgccgtggatgcttataactatattgttaacttgtccggtgtaggcgttttcatcgtatggggtatcatttctctcacccatcttcgttttagaaaagcgtggaaattacagggccataccagagatgaactaccgtacaaggccaaacttttcccagtttttccaattgtcagcattattgccaacatattcttgggactggttcaaggatggtcttacttcaaaccattcgatgccaaaaattttgttgatgcgtacatattgatacctgcgggtatcatcttataccttggtgtaagttactggaaaactaaaggcttccttacagcagtcgatctatcagaagttaatttattatttggccaaaggttgccaacaatctcccaggatatgccttcttctacagacagcaccacctcagttgttatcaccaaaacgccacgtaagatcaactggaaggatattttgacctaactcttatgatatgtttccaacaaagaataaaaatcatataattgggacgaaacatggatatgtccatgtaggtaagcagttattaattaactttttctatatcaaccataaatcataatgtcattatatatttatttcgtttcatgctcgtatcatttggcttgttcttcaattattcctctattgataagatcattctttaatgccgaataataatcattcctgtaagctgcgtcgtgagactgtttattccgtatagctgtctctttaagcttctttaggtatttgacttttttctttgaacttttagcaacttcgtgtttatccaattggtctctagaattggattgatacggtaccgacccaagccttctgaatacattcctgtattcagaatattctaaccaacagttccatttgatacctcgcttatcccaaatacatcttttggccaatgcatccagtctggtaattgaatcatgggtcgggatcgttttgatgttgctattcatgattgcacggcatttagcgatccaataattcatcacaacatgccctcccgtatgctctttaagattgataaggagcatctgatatactctgctgaactccgaactatatccctgcctgacaagacatttgaaaagaaggtcataacaatggagagttggttcaacttcaaacgttgctttaaaggtgttcactgtcataatacacatgtccattctgcctttttcggagaactgccttagatactcttcaaggaaaaaaggatctttcacgcgaaaatttaagtgtcttgcatactccataagcttccaggaggcctggaacttgtcccttttgattaatgaccggtggcatatcttgatgatttttgtatcaacaggaatatcattctctcgtaaaaagtctattatgacattgaaaggaatgtcttcctcttctaggattccgtataatagatggtatgttaaaggaactcctctttcaaccattttctctaaaaatatagctcttgatatattatccttcaaaagaaaataacaggtgttccaagttatcacatctgcagatatattctcttttttcatcctttccagataaaatattgcttcgcgatatgggagttgttgtttaattaacctggagttcctgagaaggttccttaacattaaattataagtttggacgtttggtgcgataccttcggatttcatttgtgcataaagctctctgcaggtggcaaaattgttcttgtttccgtagtagtatattacatcgttgaacactgaagccgttttcaatggcgcaattcgtaaattagaaggatgtagcaaattcttaagaagtttcggtattattccgtcttgtaaagatgaccctttgtgatggaatttggtgtgcgtcaaaagtccaatatagtcttcgaactcttgaatatcgcttagtacttcttctgttattttgggaatttcagtgaaacattccctttcaaagaaacgctttttagcgacaagagaaacattatcctcagagacttgaaaaagactagaaataagtttagcaacatcttcactggatatggagaatattctttcgtgtgcgtcttgagttttcaaagttctttttagtgtgttggaaaattgagcggctcgtttatagtcatatttgctaactcgcaacgatgttcgtgcaagatacggtagctgcaatgaattcaaatattcattatgcaccacggttgaagtgttttccaacttagaggcaggttcatttattttagttgtgcttattttggaaggacggtctttatctcgcactctaactgagaaggtaaactgttttggtgatatcttgattccaggctccgaaacagtcgatgttaatggagactttctaagatatgatcctagtaatcgaagcttgtccattatcagctgaaggtgctgaatattgcgttcactcctgtatctgtctgcttttttcaatgaatgctaaatcttggatgaatgctcactgattgagatatctataaatcgaagttttaatgtcgtttttaatttcgtgagaaaaatctattatcagaataacataactgtaaataatagtttccatttcagtaagaataacacattctacatatgttgcattttagtcttgcttttgatatggcaagatacggcaagaataaatactgtgacccatctgtatgactttcgttagaaaaaccgtattaagtacatagtatgtaacaatgactgaagaattactatatagtatatttactctgctattgcaatattggatttgctttcgataaaacactttccaccaatcatggatagtaaaaccggtaaaaagatgagagcgtggagcgatgctacaaagattaacgatgcccacattctgaaataaaacacttgaaaaatttttgattgggttagagctaaaacagagataccaatgatttttgtcatggtaatacccttcaaaacagaacccccaatagttgtcattgcataaataacacgagagtttctgtcctttttaactcctactggaacgatagtaaaagctcgagtaatatgaatgcagaattcaactgctaagcctacacaaattaaaagattaaccaacgacaccgcattcaacctgattccgaaaaagtacatcatagctaaaatgtctacaatgatcatggtgactattccagaaagaatgagagaagtcatcgcagacccaagtagtaaccaggaaacaaagaatatcaacaaaattgaagccgttatcaactttgctgttaacgagacgattgttgaatattgtacaaagaagatgtagaaaggtgagtaagcatacacatccaaatcatttagttcatcaacaattctttgagcatctttgtatgcattgatgtaatcctcttgtgatcttaacggactatgtccagttctgaaggttgaagtaatgatatttgaatcattatagacaattgctgaggaatatggcgatttgcctcccaaaggacaaggatcactcggagcatttatccatatgtcgaagtacttcatgaactcatccccttctgggaatccactcatatcgtaatcccattctccatccttatagcaggtttcacacctacgaggaggaaagtgaggtggacagatttcttcacttcctttcttcaaacggcaacattggtcaagttctggatttaagaacatcatatagtcgtcgtaccaattagctaaaggttcaacaatagaagatcttagcctttctagttctaaaacattacctagggaataatcatcacattcagtaaatttaccacatatcttcttttgtgcagatttaattcttagatcgagattcttcacaacaaaatatacagggggtccaacattcaagtattcatagacatcttggaagtaattgaccaagtacgaattttgcggaactgccatagtttggtccaatccaaacttgatagaaggcagaaatactaaagatatgataaaccaagagaaaaaaactccgagaaccttccttttcttatcgagcaaagataagaatgtcctattaagtaccccttcttcttcattatcgtccgtaagttcttcaacgttggctgcatcataatatttttcgtagaagtgtaggatgcaaacgtaacttgtcaactgtaaaacgacgttaaagcaaagagcgaccgcagcacagattgcaaaattacgcacagctggcatttctaccattgtagctaataaaaagcatccaccttgacatagaaaagaaaacaagatcgacggtgatattttgccgatcgaaagaacaattttttcttggattgtactggaagaatagtgcgagttcactctgtcaaattcatgagtaattagaaagatattgtcgataccaatcgctaatattaagaatggaataacctctgctagaatcaaagtagatttgattccaaaaatacttaaaagtcccgaggacgcaatcaccgaagaaaaaacgataagaactcctgcgcagcctaacagataccgagaaccgccggttcgtctttttaaagcccaagaagcatagaagaacatgatcaaatacgatgcagaaacaacaataatgtcactactactattcaactccttttctaatgacatttcggtattgaagctgattcgtagcccatcaggaatagacaatgatagaagatactgttctaacttttcttcccataattttgccgattctgtatgattggacaataacaatgtaacgacaaaagcgttcgattcgaatacattctcatcgctgaaaagaacattcgttttcaaaggttgctggaatgaaggcaaacaattcacgggggaatctgtacatgattctagttgttgcttccaagaggattcatcaggcaagataccttggaagtattgggtgacagattcgataacgcaggttgagtcttctgtcggtctgaagcataaatcttgatagctgatattttcagtggacaagaggttttccgtgattaggttttcagtttcaaaccaccattttaggttctcatagctcaaaacaggaccggtatcattgacgatgaaaacctgttcggtcctatagaacggaccgaaattagcatcaaagtgtgttttttctttgaatttcggggagcttggattgacccaaagattcacaggatccgtttccaaatcaccaaatactattaaggctatcaaaagaattgtaataaaaatagccgagtaagataacacggtaataggatttttgatgcaggcggccacagtgttcgaaagaacgtccgagattttatcattcatagcgtttctttcggtggcatattctacgaataggccatcatcaatatctgaattggcagcgttaccattatccagcaaaggttcactaccctccacaatgttagtggacttaatctttcgacgtctgaaaatgataatatgccaacctccaatcgcaaggaaagctaacgcatacaaaaccaaaagggcaaaggaagtgcatggtataccagctaccatgcaacgcccttttttgattggagcaagagttggacatgagtttgagcaatcagcacatgcacacttgtactttggatcgctacaggcgaaaacgttttcgtcaaacaatgagtactcatctgaacttgtctcatattcatagtttatttgaaatggagaaccccctaacgcaggctttttgtctcctaaaaatttcataaattcagaataatctgacgcaccacctcctatcaaatccatagcataaccattcgtagctgaaaattttacgttcttacaagaatcataaaatgatgatgcccatgaagagttcaaaaagaaattcaactcagaaacaatttctctaccatcactcgattcatctgtactaattatatcaataaactgcctttggttaggagaacaagtgaagtgacagaaaattgtgttgaaattcttcttacaagctggacaggaagcgattatgctttctgctttattcaagttttctttcaaagcttccatttgttctctggtacaacataacctttcattgtctcgccattcctccccacatatatccacaagaaactgtacatcgccttgatcaattactggaggttcaaagtctgcatccacgggacatggtaaagacgcaccaaagacgcccttcttaccacaattcccatacatcgcgcacgattcctgtgcatagcatgtatgtattaacagtgcgactgccacataaatccattggtaccacatcagcgtagcagaatccaacttgctgtagtggggttcacgtctcgtctttcctttatggttttaaaggtttctaaagggtttttaatcgacaaagttcaaatataactcttgttaaatattaaaaatgtttgaacctatttttcacgcttgcaacataaacaaaagttctaaagggaatacaaaaaagaataatagcatttttgtccaaacacggctgcagttaactattaatctgctgcatgccaataactgttagcattagagcttgagatttgattatgactgtgctgcacgatttaaagataacaagaaaagcgcttgaaagttggacagacaatatatcttgggggaaagatggaagcatatatatctctacccaaccacagctgactatttgtgaacctttgttctgtaagtcagttcaaaaacatttgaaaaatctctttcacgttaaggagttacatcttcttggtcctgataataaatttgagaatgttttcttagatcaaaatcaaatactaaactcacaaccggaacctgctattgtgcgcgttgtcccatcacctcgcccaggactagtggcagggattacgaaacatgcgaacattctactttgtcaagacaatcaagtgttatgtcaagttgatgatacaactgcagcttaccctaatcgagcgtatcattcgttggcatggaacgataaaagtgatctactattcacaggaaatgaaagaaatactatcgatatattctctgtatccatggacatcgtagtgacccacatgaaaagccttccattagatttcagtgatcaaagtgaaaataattgggtaacactgttgaggtatcaaaacgaaaaactgatatgctcgaatagtcaaaatgaagtttacttgatagatttagcgtcctcgaccataaaaaagatatcggaagctactaaattctcaataagtgatatccagtttgtcggaaatagagttttaattacgagtttgggctctatccattgttatgatataaatgccgacaaacacacaatagaaacatttgatattttaaatgagttctttattattaggttacctgataaagaaagtgctatccttttatctgataagacaagtgtgaaagtcgttttaaccgattcgaacatatccctctcagcagatgaagtgatttctcctctgctggagaagagatttattaaatggaacaatacatttaacgaatatcataaatacgaaaccaagttatatgttagaggtatttctccttctccagatggtttcacggttgcaatactctatgatatcgaaagattatctttgaaatactctattccatctgagcaagtctttagactgcttattgtacctctatctgataaatgggaggtatcagataaagcgtctggtttggcttggtatcaaacctacaatgtatacaatgcaccagcttcaaatatggctaatttgataagcgaaaaagtctttgatacttcccagtcattcgaagactacttatcatcaatcctaaaaagtaaagagatgctacaatggagattcagtagcttcatagaagatcttccatctgctaaaaaaatacatacattaatcttttcttatgtttccaaccacctaaacgaaatcacaaacccgttagatcaagcgtatgctatttggttatctgtacttctaggagaaagcccaccatttgagcttgcagcagtcgaatttaaaggccagtttatttcggaatattttgatttcaataagaatgcgaatgagaacatcattgtatcagaatcaaaacatgagtggaaaaggtgctgtgttactggcttacccctgatatctaccaatgttaagatttgtccagtaagtaaatgtcgtgtaattgacctagaaaaggataacttaaacgactatgggtggctttcaactattgttttaaaaatatttggtaacattagtatatttacaggtacaaaaatgactagtgtttaaactatcatcaattaataaataatacttctttggatagaacttcgtttactttaggaatgagtgacattcatcgattagatgcaaaaaacacagaagtctgtgcaaatatctctgaagttttaagttccgacttaaccctctttctgacccattcagacagtttatgttgaactttattgtttaagtatctattgtctacgagatatatgcatgcgtaatcatttgcgtgtcgaattgctcttcctatactctgattaacagccttcatacatatattctcatagaattcgatagttgctgacttagcgtcttttaaagaacctccggcagatatcaccttttgctcgatatgccgttttttgacaagtagttcactactatagagatttggatatggaaggcctaccataacaactgctctcgctaggttatcttggaaatttatgccctcggagagtttacctcccaccactgagaatagaaaggcacctttttttttatcgagaatcgtcgaggaatattgtggcagtatatcacttccaccaggagtctcatagaatattctcttattcatagacagtttttcgaaaatttcctccaattgccaaaatttgataacgtgctcaagatacccataactgggaaaaaatactacaataccatgaggtactctgcagccaagttccagaaggaagtcataaagcttgcacattactgattcgttatttctgctttcatagttgaaattgaatccctcagatacgataaacgtatcaaggtttgattctggtataatatgattgcaagaaaactgtacgatatcttttgaaggaacaaaaggcagaagattctctatgaattcggaagtaggttgcatcgttccaccagcaagaataacgcatttactgtcgtttactattgtcttgaaaatctgattgggttccagcagcatgtatttgattatcattccttcttcgaaaaagaacgaaccttcaaaagagggatttgatagggacaaaacaaattttgagattttgaaaagaattggttgcttcacagagtttgtattactttcatcagatttgagctttgaatctgcgtaactgtcaattttatatgcaattttggagcctctcatataagttaccagctcatggatgtttaataaatccgcattactatctcgaaacattgactgtggtgaaatttctttccctttctcaaagtgagattctataaatgcttgcagtatatccaataatttcataagcttcattatgttgacacggttttttccgttgagtttccttttaaacttgttgaggtaaattttcatcaacttcttgcagattttaatatcagacagcgatatttcgcagctatatatagatgttatagtatccatcaagttgtgggcctcatctattatcacaatgctgtctttaagattgatcccaagagactctcgaatttcaaaggacaatatatgctggtaaggcagggtcactatttcggcaccctccaatgctgtccttgatgagtagtacgggcacacatggagggaatgtcccaactgaaccaggtcttcgatgtcactaatttctgagaatgtataatcacggaattgctttgaagaaatcaggtccctagaattggtataaaactggcattcttgccgtttcactgtttcgacacaggcgtcatttatcaagtcactttttagctttgataccttcgcatggatacacaattgttttcttgaggcaagtggtaaaaatttgatgcgttctttttctagtgtaggtgatgacggcggaaaagatggcaaagtcaattgagatgcaaattgagttaactgtgaatgagttcttgatgagaagtaaattttcaagggggatttcaattccatgttattttctgtttttacatcatatcctttgtcaattttagctagtagcttctgaatttcgtcatttatctggcccttctcataatcgttttgatttgaaaccgaatcttgttcatagggctctggaaggaaattagtttcatcatcctcaatttcaatttctatatgtcgaggaactgtcttttttctctttctgtcgccaatgtcgagttgccttagtacaggttttatgttggacatggaaagtccctctaaatagttttcgtattcttgcaaacttttggatttctccttcataattttatcgttatagaactgattcacccattctggttcgtcgtcagaagatgagaaagtagaatccgacaaattgtcattgtccactttgctattcaatttttctaatttatgctcacgcaaccaagttacagtgctacagatcagagataaagttttaccggtgcctgtaggactttcaaagataccaactttcttaccagaattcagtagctcatatatatgttccattaactgtgtctgaatatcataaggctgataaggatgatggaaattcttacccatagttcgacaacagtcaatgaactttgctccagtgagaatataaaccttgaaccaactttgaaatatgtttactggtaagtcatacacgcatctcgtatgagcaatctaacacaacaggacttttcgaatagcaaaagacacagacatgcacttttcaataccaactgagatgaaaaatagaaagacattccaccattcactagaatctcatcgatcatatcaaatcataactattacgatcttggaaatcattatccacagcatgtaaataaaagaaagaaatagttgtgctatagatcacgtgatcttagtgttaagatccatctatacgaaagtatacgagatagaaagaactattacgtgacaactcttttatcatatacgagatagagaagtacaaatagaagagaagaatcaatcttatgccaactcataggataattaggcattatataatgtaaagatgatggtagagagaacgagcaatactcaccacacaacggtgtataatattagtcaattgatgtcagatacagataatatgagcgaaggaatatcacaatgtcagggtaacactgaacagagagattccgggactcaatacttagtgttgatgtgtctggtatttccagtcacgtgttgttaaattaagatctttggtatctgatgaatccatagcgtttattagctatatatctagtagtgtatgttgatgcacctggcgatctggcatgactgtgttgatcgtccttgtacagatccaatgcctccttatataataactcagattggttgatgatgtttcaactagaaacaatccttacgtatcatcttggtacttaaccgcctattacattggtagttacccgatcatagtttatgatccgtttcaacacttagtggccgaaagatgtttttctgacctttttttttccattatcttcgaaggtatgattcaggcatatgtacttgttcagtctacgtcattgtcagggcaatctctaggtacaacccttcaaataactgaaaacgcaggtttctccagcggtttctgaataaaatcctatacagactcattgcactttcgtacatggattatgaaaggtgaaaaaaaaaaatgaaaaggtgacatatgcaggtattctggataaatcgaaagcaagtcagaacgggaagattgttggatttcgataataaatctgctcgagatataaatgcaagttctgtcacacctccgggcaatatccggccaggtatctatttcttttgatgtcaacagtatttttttttttcattttgtttttcgagatctctaactggtggggagaagactacatctgttttacagtttctttcgttaatgttatattgggaacaggttaagatagtgctatataaaggttaatgaagcaggaaactttctgagtgccactattaagggctgtattagtagtattatcattcagaaacaagaaagcactatctctgtctatgtctactgttccttcttttcaaagattgtttatgaacgagatttattgagttgctacattattattagagttaagataagcaaatcgaaacgaaaaaatcttcaatattagcatcagaatagttccgtttcattcattaacatggcatcaccgatcttcatatcaaagaaacccacttcattgaccagtgagtatttttttcttggaacaaaatactatgggaattcattgattcgaatatcaaatgggattaaaacattgcatccagatcatatgaagaaatggattccgatattgctgctgtctagtgtcacatacgcttttgtggaagctgctaaacattgtgtttcgaagttaaactgcagaggatgtgagtacttgaagtgcgttctggatccacatatgattggtatatgtataatacagttctgtgtttcaagtttcgagaccacgttctggcaatcattaaacgaactggataaaagatatcatctgcacagtggaacagttaatctacaaggtataggaaaacaacgaacaagaacactacagttccaattacgggccacgataacgcagcttttcttgatcatgacagtatcatggtttccaagcatcgcatgccatgccataatttcaattcttacattcaaccaattatctcatcggttcggtacagacatctcatttttagtatgctctctcttgttgttgttcccaccgatgtggcaaataaagtttttgtctcatttctgttcgttcaatctgttgatcagagcgtctttagcaccgtatttcaacaagacaatgctacagaagagtgaacgacacacgtggattcagtcaagaagcggaatcttgtacggatacatgcttcccttctatctgatgattatctcaacttcttacttatctatgatagtgttttatctatcacatgtctctggtctaccagaactgattagagaccttacagacccattccccgacccatacctacctggcacgattcagatgtcaatatggaattcgaaacaatctctttggtccaataataaattgaaaactagcgatagagagaaacgagactctgactcagagtgagacttattcacgtacaattttcgggcgttgttgaagggtattcccgaatatcctccaaaatatgatccgagccattgtcttgtaaacgccctcattgctttgttctttttctttttctttttctttttttttttttctgttgttattctcttgatctttcatcggtactttcagctgcattatacttcccaattagggaattgaatgtaaaatattccaacatcgttctcgagctgtgcctactacaagcatttaagtgcattgtcaacctgttcgcatagcaatgcagattgcgacaagttgggcaacaaacgaaaggacatagattattatagattacaattgatatatcaccttttctggtctgtaacgggtgctcgaaggtgcatgccgacaattagttgaaactgcaagtttgaacgcgtcaaccagtgtcgatattttcctctcttacaatatgtagtacaatcaaagtgtcgatttgctattgttgtaaagacgaccgccaatatttgttcaattaacattctgtagatgctaggataggaaataaattttatatcgaatgagtagtgaaccgataattttccgcatttgaaaacattgaaatgccgatcctgaacggctttgctatgaacttgactacatgtggggactagaacgaagagaaatgctactagaaacataacacaaagaataaaaacatgattgaatagtgcaaagcaaatcttctagttgaatctcgagaacgacacctacgtcaacacacttgttcgaagacattattatcttacttaatcgcactgaaggcaaaaaaaaggggaggatatatcgttgacgtgttcaagaattttaaaactaatctagtgcgagaagaattcagctgagctgaaagctcattataaaaacatcagtccggcagcctatgacttttttttccagaatcagattcaaccaagaaatagcttcaaacaatatatttcaagcaaaacttagtttaaacaacataaaaaactgctcaagtccattgtttatttttctttaccgatcgcccacataggagaagcgagtctcatcagtttgtgtccctttttcaggctttaaggaatcacaacaaaaaaaaaaaaattccctcgaatatcccaaaaatccaaccttaatccctttaggactgcgtttaactttagcgaacgataccttatccgagtatttattgttcttaactgcagcattaaacgtaaaaaagaataaaaaagagtaccccaataagagggcgactggattggtgaattgtattttttttggagtcactataacgattaaaatccggctaattgcactgtactgacgcacccgtacactttataaacatttggcagcgttctctgagcgtccaccgcactggaaaaacacaagatcactcacataaaagtggtacgtttgttgaaaagtaaaatcgcaacatttctctcccacaagttttgcatatacacctgctccctgcatatgtttattctctcaaattaccagtaaaaactcgtttgtgcattgttttcacacgtctgttgacaaatctcacattttcagaaacaccactcgagcgttctttctttctttttaaagttcgtcgatatcgtttctacaggaagagaaattagaaaacggattagaaggggaaaaaagataatcctgcattgactccattcgttttttgcctttaaaacacgtcaaagggacgaatttattaagaaacaaacaggaccaatacccaatatctgttctagtgtaaaaccttagttggtaccaaacagcagtaaggaatactatcttcttttctcaggttcttttaggttattttggttagctgtattgggctaacagacgtatcaaatcacatttggctactgaatcaagtttcgttcctgaacgtgtttattcttttagaacgcagaaaccttttttctctttgaactggttacgtgcgattggtcatatatataggggcaagttatcattacctcagttcagttcttataacttggttaaccatttgggtacaacaagtacattagctttgtccggttcccattttttggtctttacaactgcatatatgtttgaaatgaacgaccatcacacgtccgttaacgggaaagggcttaggagtatgcttatcgaaaagtttcatcaaaagttctcacatgcgaaaggtgctgctgcaacacagcagcatgtggagccgccacagcaacagcagatggaacatcagcaacacacgcatcctcacatttcagtacccccctcgcagccttcaatagatccagatgttgaaatggatctcgaccatgatgaatacaatattactgcctcgtcctcggtagacatagtctccgaaaagatggggatagagcatgacaatatccggaatacgaagccaaaacctttctcgaagcagctgaacttgaatacagatgcatctacatggtacgtgctagaacaacagcaacaagtttctacgccagttatgactcctgtaaatcagtcagggccgcctcacatatatacaaacagacatggaagcatgtcatctcttgccagttctgtttcagaactgggatattcaaatggaagaccttctactgccaataatatcagctctattcctgcaccatttaccccccagtttgtctctttattattggaggtttacctacaggtctgctcagatccgacagtcactccattcgatagcagtaacccgccttcggggattctgcaccgggtatctaaagtagcagtggaaacagctgatgctgatcaagttgatatcggtctggagagaaattcgtggttgttgactttagtgagacagcggttgttgaaagaggtgcggaaagaaaactatctttcaagaaacagttctatcatatcactacctcctgttcctcagttcggaaacgaaggaatgtctaacaatatgctacagcaaagtccacaggattatttcaattgtcattctgccgaaagtacaaattctccaccttcttcctttactacgaactattacactggtttgaactcgccattcgaatctagaccatcgtcgcagcagttgcaacaaccgttacaactatcacaaggcactacgcaagttcctcctcagaatccaaaagctcttgtcaggtcacgaaacaatagtttcattacagccgctagtagatcaagaagtaactcgttcaagatacacccacaattgtcaaatactattagtggtgtacagccacctgctcttcccaatctaacaaggtcaagatcctctagtaatgctcatttctttcttactccaacaaattctatcccatcccaatcatctttcctagcacaatcaaccgcaagcgtaaatactcttttgaactcaacttcaaatgctacaaatactgctgctgctggtcaacagcctgatgaacgaaacaatagattacccacacatatagaaaatgaatccaatttatagttgcactggaacacaatttgactcgatgtaacatcatgagcactaatctccaatacaaacctgaacattacaccaaacatacctattaaatacttgagaagttagacattcactcactcattcacaaaaacataacataaaccatctttttgttcttgtaattttgttaatatttatgaattttcggaaatcacatagtttaacagtcagtattcctcgatgatacttccctcattcagggaaatatatgctgatgacgattattattattgtgtagaattacctgatagcatcttatatatggtgatatgtaaatttaatcacttcaattttaccgcatggggccaagctgttaagtgtatgtaactactacattggtttatgaccggaaaaagtgcccgaattcctcttatcaatttaagcctatatacatgagttcttgaccgtaagaaagccttgggagatggtgatttatgccctgattattgatataccgcttttaatacagtaatcggaacagctggtctattcttcaaagacttctttcctaggttcaataacaaccctactacttgtgtaggtctttccccaattttcatccaggattccagcttttctcaatagtcttgttaccgtatcactaggttgagcaccaacaccgatccagtatttagctcttccgaagtctaattccacatctttagtaggaacaacaccttgtttaacctctttcttcgttaatggttttgggattgggttgtatgttcctaatacttcaattggtttcctattcaacgccttatgtttgttggtaacaactatgttgtatactggggtatgtttccttccgaatctagctagtcttatcctcaccaaacctttcgtcatgattattgtatttcaccaaacttggcgttaaattctggtttaagagacttggtttactcgctctggtcgtcttgatacataatatgtttgtcctgttattacgcttttaatgttgattgaatttttttttctatctttcgaaggattttcaacaccaactaaataaagcatgtctatcacgtgatataggtgggatatctaacagccgtatgagcaacattcgtcttaggcgtttatggcgacattacagcctaatagtataggaagttgatctatgagaaagtatctataagtgagaaagtgtttatttactggagttagactgacggtgggaattagtttaccaaaaatgcagtcatataaaacgacttggcattacaaataacatcgcattcagtaaagaaagttaacgacacaaataatgaaatagtatgttcttgaacccgtttagcagacgcatatatacagagttggcatatattaaccaaaatttatttactttttattctctgctttcttcattgcctcacgatccttgctgcttcatcactaagggcttaaaaagaaatttttcacaagctgtataaaattttcaatctagctcatctcatcgctcatctcatctaacaagtagagacgagttataatcaacaacacctcagaaaagagaattactgagtttaacttgggattgaaaactgacaagcgaacaaattgtgcaatatgggtcctgaacaagcgtccaagcttcttgaacttgaagataagcttgctaaaatcagaggacaatctacatcaaaactagagaatcagaagcacattgccataatcttggctgctattgaagaaaatattaatgagcaagaggcaattaataagaacatcgtgaattatcttatttctttgatgtccttgctggatcaaactatcgatacagaaactgcggccattaaagatctacaattagcaacatcaacgatgtatttgttggacatcatttttcattatacaccaaagaaaatattaaagagcaggtttgctgatattttgattaaagttgccccatgtattactgatgaaaaggctaacgctcctttgatcaaatccgctcttggttgtttagaagctttgttaattgcccaggatacgcaaacgtggaataacactcaaaatttaaaggtgactccaacaagaggtttggatggtctacttgagctatctctagatccaagaccaaaagtaaggaagagagcacaggatgcaattaccaacattctaaaaaaccctccacctggtccaacagcagaacacgtcgcatcacctttgatctcagcattcgctattaatgcattggtatccatccttgatgaatctgcaacgatttccaataagaagctaagagcaatgggaggtgcaagtgaattgaactccaaaatcattcatattttgaaacttttgagcaatataatatcaacaaatcaatggccaactgcgcatgtggaaaaactctgtgatctgctattggaagtttgtaaaacctcggaccaatttttggtatctaattcttttaactgttttgaggttctattccagtctatggccgagtcttcagtctcatctggcttagcggagaataaattcatgaaagcccttgatgtcattttttcattaaaaccatcccaaaatgatacacatttggcagcagcctggattgcagtcgtcgctaaaggtatcagcacatatgcgattcacgatccattaaagtgttttgttaagattcctgaagttttcagaactttatcattttacctatcaagtgagattccagatatctactttagcgcagcacaatgtttaatcgctattgtcactgacgcaatcaaatcagaaattttgttgtatccaccttccgtttccgctgagcactttgaagcagttgatgaagttattcaagagttgtctgagatatttgtggatctattatctattaaatacacacattgtgctaaggcagtgttaaatgttttgacggctactttcaaaaagttgaaatatagagccaatccagattttatcaaacctctagagattgtaggcagttggagaacagatgaacaaaacttcttggacttgagatccgaggcagaaaacgttatcggtggggctatagaagctattggtgtagatgctgtactaggatgtttaccactaaatttaattagtccatctacatcaaaaccgggaagggcctggttgttaccaatattaagagactccatccagaattctacgttaaatacatttttcaaagagtttttacctcttatcaaacatttcgaatctcaattcgataaatttggtaaagaatctgttcagttaaaggtatatcaaactgttgtagatcaaatctggtctttattgccaccattctgtgatttgccaaccgatttgactgaagctttttctgatgaggtggctgctgaattgtctggtttgttatattcccacgttgaacttagaacgactatttgtcgtgctctaagaaatctcgtcgaaagtaatctagtatatcaaaaaaactcaactacagattcgcttcttttgcaacacttttccatagaaagtgctacgaacagtttagaatacttgtctaccaaatcttctaatatgttagcggtgctcttcaatgtttatactcaaaccgctccaaacgccagaggatatatccttgagacaattgattcttatctgcaaataacaaagaaagaagaccttgcacaaacatttaataatgtatgtgggctcttgaatactgctcttcaagaagaagctaaaaagaacaacaatgaaatgtctgctactttgctcgatttagttatcgcgatggtaaaatatgttccaccttcctcatatggtgccctctttgctattttcaattccatcgtcaactcagaaaatgcattattccaaaagagagcataccgtattattcataaactttcagaaatcgaagaaggttccgatgccatcacgaatttcatatctgatattgaaaatgtcatgttgaacagcgcatcaactgttcacacttcctctaaatcagcaaggttggcggcaattagaactctcgtaaatttacttccacctactcaactaggatttattgttcaggttgtggcagaagtcatattgtgtaccaaagatgtcaacgaaaaatcccgtgagacggcttttgaaattcttatccaaatggctaacaaaatggatagttcagagggtgttatcaaactttcctgcattccaaattatgaccccaacactccagaccaaccctcttccgttgctgaatttttcagaattatttcagctggtttaattggggaatcgcaacatatggtaagcgcaacaatcaccgcatattcttgtttggttttcgagtttaaagataaagttgatgttgatgttctcttagaaatttatgacacaatcgaactatatttaacctctaattcaagagagattgtcaaaagtgcgattggttttgcaaaagtttgctgtttaggtctcaatgatgaagtcatgaagcctaaagttccagaattacttcctaaattattacgttggtctcatgaacatactggccatttcaaggcaaaggttaagcacatcatagaaagattgattaggagatttggatacgattatattgagtcaatattcccagaagaagacttgagattgcttgccaatatcagaaagtctcgtaacagaagtattcgtaaacgagatgaaggcgaagaagaagcgccagcgcaagctgctccttcaaataagtcgtctagattcatgtccgcccttgatgaagctctatattcttctgaagaagagagtgaagatgaagacaaaaacaatacaaaatctgatagaagaaagaagggttctaaacaattcattgtcgagtcgaaggagaccccattagatttattggactctcaaacattggcgcatatttcctcgactagaccaaaatcaaataaaaatgaaagaagaaggattgtcgatgatgaagtgttcagctttgatgcagaaggtaagttggttatgaaaaacgataggagaagaggagaaaataacaatgaagatccgttagaggctattaccagtggtgttaatgcatacttagatgctgtcaaacaaggtccagtaaagggtcaaaagaacagactaaaattcaaaaaaggatccagagctggcaatgaggatgatttcagtgatgatgaacaggaaaccaagctaccaaaaacaaaaccagctgaaaagggaagaattggtaaaaaatccaatggtagatttaaaaacaagaggagattataaatcacttttacctgatatgcactgcaacgccctagcccatttatcaatttgatagttgtatatagatgtatagtagaatagacaaaatcggaaccaaaagattgttacatgtgattgatttgaaaacaatcgagtgagagtgcgattgttttgtcgtaaacatgaactaattttgtgttaaacaaattatatttatatatcgtatgcgtgtccaaaatccaaagatgcccttctttcaaatgtattttgcatgtcctccatttcgtctaactctgtggtaactacattgcctaaagttaagcctcccgttccagaggtctcaaaatcataatccgttttatcaatatcggtgtagtcttgctgatcttcctccgtatggaggggttcaagtaaatcgtcaatattctcatcttcatatgaaacaactatgttttctaacttgttatttgggttaccgataggtaactttgagatgagtcttttcagaactatttgctctgctgcgtcttcagtactttcctcttttccttcttcatcttcgttaatttcgattccaactggaatgcatgaattggtaatgataggtcgacttcggcttagtttagagtattttaatccaggaattgacggtaacgaaatgagatcttgaggaagtttccccgacttcctcttcgcaagttctaatttttgtgatgtcaacatgaattgtatccagtcatccatatccccgttgtttatcattgcttccaccaattctgtctcatcatctccatcgttaggctttttgtccgatgtattcagctggttgatatactccggaatcattgacaatggtttactagttttatcaccaactttcaacaggtctggacttggggtactgataactcgtgcttctgttgttgcgggatcttgaagtaaccatcttttaaactgttgcataccttcatcgcctgccacggacgggttttcatcgtaaacatccagtaggttcattggtttaaatacgccgatattgagcattccttgggtaatatcttgaagggacacttcttcatctaaatcacggcgatccagagtaagtttccgtatttcttgaatcatcagttctagatatctcacatataaatcagtaaaaagattaactgtccccattttggctctatcgaagccatgtgcccttaaaaggtgtatcattgaaattcgcagcagcgaaaagtaaaaactttcatcagtggtcataattgtgaggagctgagtaaagcaataacactttgcttgctcaatgcttagagcgtagaatatacaaaatactgcaaagtctttgcaattggccggtatttaacttatgataaataaatcaaagtaaatactgcttagtaaatcaatcagtgtcctcgaagctcagtactggttgcattctgcatcgaacgaaccccacaatagacagttttcgttaatgtatagtatttgcatggctaacctacttatcagacagtaaaagttacaagttccttctgtgttttccattacccggaaacaaatcacgtgataagagattcgatcaaacacttgctgtttggcgttactggagcataaatccgtattcaatgatatcaacaggctttcattgccatggagctttttacatggacagctttacaagacatccaaagaaggctactgattctaattacaggaatgggcaatggttgagagctgaattctgcctctctcgagcgcagttcctatttgtcctatatcttgtcaactgcaaatttggaattttcgcgtaccgccaaaccagcacttccctcctgagacagtaaaccattgcatcagtactgaataacacgaatagcataccctggaagtaaccaagaagaaaaacataaacaacatggttaacttatctctatacacagttaaagctgtgttgattttggatggagaaggaagaagactttactcgaaatacttccatccaccacacgaagaaatttctgcagattctcttgcatccagcttaaagaagcaaaaagagttcgaatctaacctatttgctaaaactcatgggcagaattcagacattatgatatcagacgatctattagttatttacagagaatatgtcgatgtttcgatatatctgatcggtgcaatcgacgaaaacgaaattgttttgcaagaagcattcaacgggttcaaagattccctagaattgatattggatacaggtattgacaagaggagtgttcaggaacattatgacatggtggttctagcaattgatgaattgattgatgatggtattatcttagaaactgatccagccacaattgcctctagagtgacgaaaccgccttcaaaggatatcccattgaatatagaattgaatgaaaagggtttgctaagcgcgtggggctttgccaagagtaaattggctgaaagattacagcagggcttgtaagcttctcctcattttccagatttcttttataatcagacacatatgtttaccatcgatatgtaaatactgtgtgaatgtctttgcctcttctaataaagatgaaactaagataaatataaatatgaaatacagtactttcactttatatgctaattagttgattttaatatgacagcgtgaaaactattcgattggtcaaacatatctctgaatgataagaatttgcttgatattttttgtcatcattttttagacttcttacctttcgccattgattgctttgatttatgtgatctgcctgaggatgctttgtcgtttccacctgggatggaaatcttcaatttatcagaacaaataataggaacgacatccaaagttttgattagctttattgtttcatgttctcttggccaatctaagtctttatcgtactccgaactgtcgacagttctattcaagaagtaatgtagagtttcattaatagatttgctcttctttgcagtgccaggctgtattttgactttatacttatttttagttaaagcagcccagggggcatagacagggataacgtcagctattttatcatctttggaaataccggttttcaattgattcaaaaattttggaatatcaacttcgaccttttctgatttgttaaactgcaagatgcgagtttgctcttggtttttacgtatccgctttttaaactccctcttttcggctctttccatctcttcaagttttttttgcttctctctttcaataccttttaatgttccaagtgcttctagtctcaataatctttcttcttcatcttggtcaaagtacttcttttggatttttttcaatttccctctcttaccacgaaccgctgtattcatattttcaacaattgaagtagctatagtcttactctcatcaaaatcctcttcacctttggataaatcactatttgagagtttctcgtacccatcagtggcctcttctcctgctaaagccacttcatcgaaattgttgacatcgaaccctagatcattaatttcttttgaaataacgtttacattattatcaatttggtcgactgggtttgtttccggctgagaagtatgacttgtatcatcgtcagatgcttctaagtcactattttgttcatactcaccctctttttcctcgctatcctctgtctttactttccacacaagtcctaatcccatcactaattgtgctggtggcaacatgtttttagctttaggttgtttcattctaaatgatccaactggaagaacactgccatcaatgtcgtcaaatttcgttacatttttagcgaaacaccaccaaggagaggatgcaatcttttttgaccatgcatcacttgcagaatttgcaaaagtaccagcttgcattagtgtgtttggtggtacttcagtcttctgagggttcaaaatccaagccttcacgtcaaatgcattggtgaccataatgtcatcgtcattaacatactttgcataaagttgatcagtttcgacgggactcttacccatcagtacgagaaaactttcgctagaaataaaccagtaatatttttcgaaaaaatatggagttctaattgctttcaagatatcatgagattcctttgacttcttttgtagatctttttcgatcttttgctggatactttttaaagccttttcagcattcttctcaacttttttttgtttctctgatgtcgcctttttggcgttgaaataactggaggcgtttgcaaatgccgataaagataaatcgactgtcagcagaacagtttcccgtttctctgatgttatcttggattttcttctactttgctgtttacttttggatgaagttagttcttcaaaatcagaatcagaataatccgatgagacagaggaatctgattggttaacatcactttcgtttgatgaataatcagcttctgactgatgatgttcagtagaatcatcctcgctgtacccatcttttggtaattcaatggtaattttattatttggtaaatccattggcagcttaatgatccgagcaatcttgttgcctttccgctgctcgtttgctattaaagtttccatactttgccagtccatttgttggtccaataagcttttaactgcattcttggcctcttctactaaatttgcattagctatcaaaatgtttcctttttcttcgttagtttgttgtgcatgtaataacgattttataatagtttcattgttattctttgcctcatccaattttttttgagcctggaaatcctgattttggatacggctagcatatttgtttgattctattgtagaaaagaatgtgtctacggtattattgtacattccgccgatttcgataattttgacgtcagtggaatctcctacaaagggtttgaagggatggaaatttgaaaaagtgtattcaagttccggcttgtctcttaaaggatcgtacagtttgttcttatgagccactatataacctattcttgttgacgtagtcgagatcaatttatttgcttgaacttctaatgaggacattaagtcaacaagcacagagacattgtgtttaaactcaagacacgaagaagatggatcaataccaatagctttcaacgagttttgaatcaaatcacttgataaatgtggagcatgaacaaataaaagtttttgaatagacggaacagatgcttttcccttgagtttaccttttttagcctctccgggcacaattgtgcttttggctttaacgtcggcttctttcaaccaatctgctatttcattttcgaaatattccttaggatcaggaaccgtagttgaagtttggttaatttctgcaaagttggccatgtcataaaattcaccaactttcatcgaataatcatcgacaactctctgtagtaaaagaattttttggtcagcatccaataaaagcacatttccggcactgaaaaattctaaaacaaggtagtacttaccatcagcaaaagtaaacacaattattctgtcatttgggatctgcttaactgccgtcaatcgtttttctttcaaatacgatctcaatttggaaacaaaccacgaaggagtcgggggaatcggcctggtaaagtcagtagtatgaactcgcaatccgcaatcaatgacaacgtttaacttggaatcgggttttccaaactttaataagaattgcctgtttgagtcagcaatgttatagatatttcttaagcgaaatcctacaatttgattctccaactctttggatatcagttgcaaatctaacgaactcaatctctgtttcattttctagtatcaaatccaagattatagtttagatatttcgtactctccaagttgcagttaagtccactttaccagtctgagttgattcttttcgagcactatacttgattcagatcttcatacaaatcagtattttcactgctaatcagattaaaattattagaacttggtcactgctattagatcagatatcttttattacttaggtttaagactaaactgctaagctgatatattttccagatagctgtacctaggatgttagtagtatatgtcatctttgtctattcgcaatcactttatatatgctgctaatgaaggaaagaaagactacgtacgagtttgtattggaactttctaaactaccatgttgaaaaatgtcaaatatttgaaatcacatgacctgaatttcaaattttgaactagaaatccttaatatgtatatcatcttgcacggtgaaatttttcatcaaacaacaacccaaaaatgtaattcacttaacaagcaaagtagtttctatgctcaaaaataagtgatcagagatattcagagaccgtttgttggaagattgcttgaacgaaacgcaggcaggtagcgacttaaatcacattacttgtgtttttaagagaatataataggatttgtcgacaattctgatctagaaatcgatttttgcccaattagtataggagtccttatattcctgaatcactgaacgatgtcattcttcggttttgacgccacgggccgaaaacctcgtgagaggaaacagcaaggcgaggaggattctttagatttcgaagaaacgtatcaaggcttgggtgattatgagccagaggaagatgatttgctcaatgatgaaacttttggtactggagcggatctgggtacagattttgattttggttacggtaaaggggagcttggcgctggttcaggttctggtagggcaccagcaccagctcctgtttcttatgcatctattgcaaatgccaaaatgaacagacaagcagactgtaaacctggtttcgaacaatcgctggacatgcaacctatggaatctttatggggtaacagctccggtaatcagcaacaacaggtgcaacctcaagcccctacacaattccaagccccaccacaggttcaacagcaaggtgcacctaatgtggaaggattggccattcaatctttagacagacaacaacagatggctatgccgcctcaacctggattctatggtatgcaacctccgcagaaccctggctacggctttattccacaagggttccctcaaggtcaataccagcaattccctgggcaaaatattccccctgttatccctaatcaattcggtaatgccggatttcctaatcaacctgttaaccctcaggaacaattccaacaagtaccaccgataatgtacaatcaaacacaaggaaacattgcacatcatatgcaacatccgcagatggctatgccaccaatgcaaaatcaacctcctgttcagccccagcagccccaccaacagcagttacctccccaatacttgcctcaacaacaccaacaagatcagcagcaccaacaacaacaccaacagcaacaagtgttccaacagcctcactccgttgacactgctgctagaacccaagctgtccgttctactcaagattatgagcattctaactctccaacacctgtgccaacagaatcagagcaggtgccaactccacctcatacacctagagagtatcgccgtggtccaaggaggtttggcacccaagatcctttgactgatgaagaattgagacgtcttcaaatcagacaatcgaaggttgacaaaattctcagacactctggtgtaatgactccaagagacaaggattttatcaccaggtatcagttatctcaaattgtcactgatgatccctacaatgaggatttctacttccaagtttataaaatcattcaaaggggtgtcactccatctgaatctaataaggattctattgctaaagcatatttagagcactcgggtcacagattaggaggtcgttacaagagaactgacgtcgcgttacagagaatgcaatctcaggtcgagaaggctgttaccgttgcgaaagaaagaccacagaaaagtaagggtgggttggataatgccaaagagggtgtcttgggtaaaatctcagctactaggaactcaaaagctccaagaaagcaattacaaatcccaactcacaaagaggattctccagcgttgtcttctcaatcaagctcagccctagatgaggtgtctgaatctttgcaaggcgtggatatcaatgccaaaagaagaagatcatcttatgctttgagttcttcagtggaccatcgtacagttttatcccgttctggtggccgtaagttcattttatcattgattgaaactgtttacgaagaagtgcttgaactagaagctcaattgagatccggtcaacagccggacagttcaaaattatgggaggcgctacacgttgaggaccacggttttgacgtttctcccttcatttccatcttatctttcgacaaaggtatcaagattatgccacgtattatgaatttcttgtcaagagaagagaagattaagcttttcaactgcttcttcaaggaactttctcatttgaatgtcattgtcatatcatcgtacaagactactccacttcctactaaagatcaactgaagaagatggaattgttccaatctgtgtttttgaagatcattgtttcgttcttatccagttcagcagagtttttggaggtaatgagtctactaataaatgtcattcagaataataacgtttctttcatcaccacatcgcgtatcggtttgaatttgattaccgtgctcatttcacgtgctgctttgatgaaacaagatgttagcaggggcaaactgttgtcttctgtggaagtatccacttggagtgaagtctatgataggctatttacttctttagaaacaaaattgactgcaattttcccaacacctgaatatatgcaacacgccatttcagtttatgaacaggattctactcagtatgatcaatcttacatctggcagttccttgcatcgcttgctttgagcggaaaattgaaccatcaacgtatattgattgatgaagtgagagacgaaattttcgaagtcatttcaaaggctgaagaactaaatgccccttctcaacaagaccctaaactggcttatcaaagaaacaagttctatcaggatttgaacttgttcttgaatgtcatgggtcttgttgctcgtgatggtgaaatcactgaactgaagtgatcgatatcgtgcgcctcctctgatcagcccctatctcgattgccactgttaactgtgtgctacaaattcgaaatcaaatctcaaggaaaaaaattgcaaaaaaaagtcagctttatagtatctaagtaattcttctatttactattacaaatgtatcatatttccatctactagaacacttcaatccttatgaacgccgaaagtgcaatatgtaccgtaaagccaaatgattcggttcctgttcctcaccctgtgtttctgttaagttggaatgtttaatttttgtattttgctaacgtaaacaattaattaattggaaaatgcaattctaaagggttcagatataaaaatgaagatgagatgagacaaacgaagaggataagaaaagagtagagataaccaaggccgaaatatatcaggctagaacatcacataacactcattggcttatttgatatcatggcagagattcagagtaaagttgcgctggttaccaaatttgtgttaaaattcttggaagatcagaacattataaatcaatcctcaggattaaggtggaagaataattcagctaaaagcgctacagttgtcattgttgtcgaaccagaaactgccagtaaagttttcaaaaagcatctaagtgatctagaggttgttgcattggaaatgggtaattcggaaaagtgtatggtgaacatttgcagtgatgatgatagtttggttcaaggtattttccagtattctacgttatttggggagcaaccatctttgagctttccaatatcggaatcagagattaactcactttatactgacgaggttttcaaaataattcagaccaagtttaaactttttgcaggtctgagtggatctgcactacgggaaagaccatctcgatcgccaagaattgatgaattgcaatcaaaagataaagatgatattttcaaggaaagggttgaaaggatggtagctaaccaaccaccaaggaatcctcagattcctggttttgatgacgagtatgagatacaaacaggaccaggcattccaagttctggggagtttggcgttccaggtttagggctaccagtaagtggatatggtgataacgatttgtaccctaatgggctgcggttcccacaggattttgatccactgaatagaaatagtactaatcagcaaggcggtatgatttatgatccattcagaggtactggcccatcaccaaatccgcagagtggcaaccatgatccaggtcaaaattcctccccagctggcccacaattccccggaactaaatatgacgatccatacggtagaataaatcgccaaggtggcggtggaggtttcatttagcatttctattggaaataaatacattgtttaagtatgtagaaataaaatatgtcgtattgcgtacgaatagctatattcatgttgcttccagataaaatatgctcatcgatgggacccgttaatagaatatcattattgttattcgtctgattttgaactatgcgtataaacagcaagagttttatcctctcgtttgtatattaacacttggacgttatcgtgttccaagataccgaatccatcttgatctagttccacctgctgtaattggagaacatcttcttttctctcctttccaattcccactgcttcaataatttgaccagcatcatcaaaagctatcattccaatggcattaggcaccatttcagccaaattaagactcatgctaactttagttttcgattgacttctaacgaatgaaatgtcaggatgggcactatttctgctggccggacttatcttaagttgacaatatttaaattagcactttcgatattcatattataaagtaaagccaaaaataaagaaaataaatataaataaacggaagcaagggtgtaaatcagtaagactttgaaaacattgaccggtgtgtttgttggtagtccagacaaggacttgaaaaatatccaatgagagcactatggctactgcttttacttgcagttatattcatggctgtggctgctttttactttgtcaatcgggttttatcgttcaaactttataagaacaattatccagccaccttatttgtgctattgcttaatatgttcctcttactctccatcgcatacttacttccattggatgttttttgtgctgctcagagttctggcattgggcaacctaaccccatcaattctacactctctgcaagggacgacatatcaccattatcgtctgcgctagagactgcaccaaactttcatttcttatggacctccttatattggtcgcaattcgccatatgctggtttattttgccggtcttaatatcatacgttgaattgaaatatctttatccacacgacacagctgattcttggagttatgtcttgcgaaggacaaaaacagctctctataagaatctaaagttttatgtcttctgcgccctcgcattaattgttgggcttttatatttgttgatcgctacaaaacatggcctcaacgaggtaaaacctttagtcattgccatgtctcatttgtattctttgagctataccctcatacttctctcgaatggactagtaaatttacctaaagcattattatttcaagtgcaagatgataagaaactttttgtgaaactcagtcaaaataatgaggatctaaacgattccaagttaagcctgttagaggtagcagagaaagtcctttctctcaacgttcaaaatgaaccggatgtcatattgcagcaatcagtccaagaatgtcagatggaggttcaaagactctgtaatgaattgagtttaacagttcccgtactgcatactacgactcggagtcactctttgactttatccaaattgaacgactattataataagtttacaacagagtactacaattacacatatcatcaggcaaaatccaacgagataatacacacattagtcagatctcagcgtaaagctctttctgtgtctattaatatatcagttaaaattatgggatttgttttagtgtttatgtcagtgttggtatttgtacttgagataacacccatcaaatttgggcatgcctcaatattcatgggaacaagcatttggaatttctttctagaaatggccattttattgcataatactatatgttcattatattcattattgcatgtcaagatccacaatttccatcttgtcagcaatggtaatagcagtcctaagaatgcgttgtatttttccttgtattcaagccggctattattcccattgtgtttcaactatatgatattaattcccagagatcctgacgagcaacatcaatcgagttttgataaggtactctatcgtcaattagaaaagatacctttggcaaaatatttaaacgagtatcttccgatgtttttcgttctaatcgtaccgatagctcagtacttcgatttgaaagagaaggttctgtctaagttgctaggtgaagaatattattatcaattatttggatctattagctcacgtgaaaggcctctcacaacatcaacaacgcaaagatcaagacttgatgatgattatgaatactctttgcaggacggccagtacttatatgaaagggcaacttcgcactttgacatgaatgggtgaaaaaatagataaacatagattatgtatatttccgcagtttttggtatgtacaatataattccggtattaaagttttaaagataatatttcaggcacattataccactaaatggaaactttctgaaaacaattctcactgtagtggttcgctactcgtactcaatctgttcaaatgcaaatagacatctgttccaaaaccttccatggacatcagttttagatcaccaccaaagtaacgcgcatatagtctgcttaaggctagcccgtagccataaccagccataggtattctaaagttctggctcatttcttcatccatcaatccaatttgctcattttcaggcatagttgtgtagagatatgtccatactaacggcaagttcgaccttgctataccgccaccttcatctgaaatctttacagtcaagtcttccgtaccctctgttatgataactttaacgtccgggaacttcaagtcatacttatccacagatggatttttttcgatagtcttttcgacagtggctcttagcgcattctttaaagtttcaaatagcatatgaatcaagtggccaggtacatacatgaattcaatatcaggagattcgttggggcatccagacttttcttcggttgaaggccggtagtccaacgggaaagttaataattgaacttttggagcttcatataatccgtaatgttcggcgcaaatgtgccgcgcattgtcaattgctgtcttggaaagttgagtgatattggttttagtacaaattattccaacccagtcctcatcatcttcgtcaaatggaccttctgcaggctgtcttgccgattctaatagagccaattgttgcccaatcagcattctaatcccaattctcgagaggtaaaatctatccaggaaactttgaatggaatcatcgacaacattctgttgatgagtttttttccacttaagaacacccttagctaaagttattacggtagcgtcatgacgttctttgatattttgtaacacattgtagaaattcctattgaaaagaagaaggtctgcaggccagaattgatagaagtcctgagatttgttccaaccagatacagtcgaagacggcaaaggggagaaatatttctgcggaagaggtactttaccgcctgacttattatgttgtgagtgatggtttgacgatgggcctggaattttcatcacgatgccatcatcgatgaattttttatgcttgcagtataaatgattggatgaacctttactctgttccattgattttatttcttcttgtgtaaatagaagacgtatcaagtggtctacatttgcgctattggatccataaaatagcgactgaaagatcgcaccgtgcttctgagattcgtcatggctaaaattgtaaagatcctggaacgattgagtataccaatccctaacggtgatgacttcttcaactttatttaatcctctgggaagagactccaattctttgatcctatgtgccaaccgtacaggcagttcatttagtaaaaagcaagaagccttgaacattaaacctggggttggatgagacccaaattgacacatttgacgcaaggacaccgctgtttgcggtgtctccgagtattgccatattttggtcaaaagagaactcggaaatttcacagccattctgctttatcggttcctgtattttaacccaagaatttcagaaataaatagagatgaaaaagaatagttcctgcctatttgagatcacctatttcaactagtatattgttcgagagaaagtgaagtgattaaaccctctactcaatggtgaaaatcaagagaacttgaatgattcttatcgaaaattcaaacaatccaaatattttatccactgcacatgaaactaaagagacgcaatcatataccacagtaagctcagtaaccttgtctgcagattgtctgaacttttggcttgcagaacaaagaatacgaaatcaaataattcatagctttaagtactcgaatgatgaaaagaaaatacaaacaaaaaaaaatcatcataataaatagcgaattaaactaatttaaacctggagaaacagcaatctcagcatattgttaattttcaattttagtaattcgatgaactactttccctagttgtttttatgcagtgctccctaagcgatcgatttttttcactgatgttcgtgatagaagttttcaaatgaacctgtagccttaacggatgaatggaagttatgaggtttgtgcgctttgaaaacccttttaagaaactcattcctatacgaaactttctctatgcttttctctcacagattgcgaaagaatcacgtcacgtgaataacgattccttcacagaagattttggtgtacattgccaattggaatagttcactgcaatgaatgtcatttcgaggtcttgtgttcggaaaatattgacactggtgcctgttaacttgatctgctggaaatgctgatgcaacaatcgaaattctactgtttttcctcctaacaaacctttttcgttcttaagtattttttctatttacgtcaaacatcgaaagtaacgccaaaattctatgagaatggattagttactagttatagaattgtgtggttatggccaaaacagaaacggatttattcttcatcggaataagacaagtaatcctttcagatagaacttcaacggtactgtaactaagcatcagaagatggagcagtaatggaaagggtgctgggaataacatatgtcatttgttggtccgtttcagtgtatccagtggtctgggccaattggaaaaatgggaatgctaatgctgtgtcatttgattatgttgtcttaaatactgtcggttattcatgcttattagcatccatggtattgcagaaactgttctgggctgaaggtactgatgaaacactgattgccccagaaatttccggatcagatctcatttattgcgggcatggtaccttattgtgcttcgttctcttatcacaatttttgttagggaatagactatggaatttctcacacactaccagaacgcatccaaagatgcatacggtgtacaagaggatgttttccatcataatgttagttgtcttggtcataacgattattttctttacagatattttaacagttggtttgtcaaatgcaacattactctcttattgcaataatttatcacttgtaaagatcacaatgtctctgataaagcatcttccccaggtgaggcacaacttccaaaggaagagtatggcaggatttcctatccaatcgacttgtatagacgtcttggggagtgtatgttcattgagtcaattagctcttcgtttagcttcaaaaccgcagggattgaccctgatgtcctttttcaccaacttcgggaagattggtattggattgatcacacttttgtttaatattgtgtacgtctctcaatggattgtttatagtttatcaccatagatttcttcaactgcttagctgaactgaaatccatacatacaaattagtgcttggttaaagtagttggatgaagttaatattaaatatcatacatttctcagaagctggagttgtaagagagttgtaaccttgcaccttgttcttcttttaatatttagcgactcaatgtgacttctgaggaaataatagtgaactttaaatgattttttcagggttggcatagaacaaaggatttcatttcataacagtccaaaagcctagctctgagtggtataatgaaatgctaagctgtaaaattagacattgggttgttataaacactttaaatggtagcttttattatatatttacaacatttccatttagccagcggaaagaataacaaaaccagatattctaaacttcgctctctgcttcagattcactgtcgctgatggcagcagagttgacgctagcagtttctataggtctttggaaatctgtggcatgtgcccaaggaatgatttcaaatacagaagcttttctattgagcttaggaacagcacttgtcgaccttggccgctgttgttgtgattctaggtccgacttcataactgacaacatggcgatgttgtccatgttttcagctgctgcactgtaatcttcttccatatgtaattcactatcctcaattgtagggaatggtagttgccagttatcatcagtgactttgaatagatgtacatttgcaacgtgctcgttttcaacacgtaatataacccatacaaatcgccttagaatctccaaagtggccattgctaacgcaatcaaagggtggcgcacataatctgtattgtttttgaccatgtaaaagacccattcgtatctgacaaccacatcaaagaccatgatgaaatagtatatgcacttctttttgctgctatattttccagatttccaattctttttgccacataagtacaagtcgtcccttaataaaaagttcttagatttcgtttgcagtaacgaccaatccataattaaatcccatatactcgtcaaagtcgagttcaaacatccaaagacgattaatagaactttgaatttctgcatttgaggccaacttttataccagtataacgacgcattgaaggagatacctaataaatacttgaaagcgtttaagaggtgagggaaccaatcatagctatcaaagtatcttctcacacattgaacaaatctccaataactaggcaaacatgacaatattccgatccacatcaatttttcataacgacacttatcctctttggagtcattaaaagttaaacaccctaaagtcgcaaattgtgacatggaatatgtcagtgaacatacaatatcacctaagaagaaatcaccgaactgaaccgggaagaatcccgaaaataccaaacggataaatgacgtgaaaatatactttcttgattggaaagtttcataccaatatggccatggttgtattacttgaaacttccaaaagaatagagcaacagcgatgcacagccacgtgatcatccacggctctagcttttcgagcatcaaactacaaaatgctaatattgaacatatgcacaggaatgttgttgcatggaaaaattgaagaggaatgtgtgtcatcccaaaatcattgttgaataacaccggtccgtttcgtgaatgaatctcaccaaacataatgaacctatagttgattttaactttataccaaataaaacaatctatgatgaatagcaatcccataaatgtgagatagtggaaactcgaccatatgggtaacaatgctgatctcacttcatcagaggaattcttagccaatatgatggtcatcaatatgactaatgttacagaaataccaagttgagcacttccaaggaacatctgaaacatagatgcgttatttctgtggatggtttgttcattaacagagtactgtaaagataaattcttgatccgctctaagttatgttttttatcttttgaagaggaagttaaggtcatggtataccatttaattgcagtttgttcccagaaagtcaaaggatcctttttcaaacggtcaacatcgttatcactgccaaggaacaagttaacattaataacctctgcatgctcaacattatccttgatgagtttcaaatactcatcgtattggctgaacataatggagtattttttagcatatggcatgaaagtcttcaattgatcttgatggagaactttatcgaacttcttaacaattttccgaaatccattaacgttcaaatctctatagtttttaagcaattggaggtataagtagaaatcgagaatcgcgtcagagagctgctgcctaatctgagataaagagagaggagaggtttcggtttgaaaagtttcctggccccttgaagctcgtttacggtcctttttagctaaaagagggtctctattcttccaagaaacgggcatagatggacataagttgtgggtcactaaccaccgcttgagatcgtaccagattttttttttgacggtatccttcaaggctatcggactaaaatttgggaatatcgatccatacgaatctggggctctcgacaaactggcgatacggtactcgtccagcgaatctaatctactacgcttatctgcttccagcacatacaaatggatctgcctctgcaatttatgatatttagctctgtatttagagagttgccattcataaaactcatcgcagttcttcaactgatctcgcacaagccaatcatcaatgaattcacgaacaatagtacgatccatggatccaacatcttgaacctttttcaatttttggaactgcttaatctttttcttaccgagtttatagttaacatacttatcgctccattcaggaactacagactctcggaggtgctcagcaaatttcatctctttgccggatacccaaggggaattagaaaattaaacagactctggattaaatcaccttcaccctcttgccctgatattgttgactcacactccaaccatattccttacacaagaagaggtgtatgtgtcgaaatttggaaagatacatgatgtgtgccttcagccaagtaaataccaactatatcccttcataaatcctttcctttctttatatgtctttttgttcgcatatatatttttcgctcaaatcaatgtcacatactgaaagcaaagcacaaacatgatgctggtagtcacgcgtatgctgatttaagtgcgaatttttagatgagtcaaatagaagagatcaatggttctgatgatataaacagagacagagatggacgatatttgacgaaaaactggttgcgttatgtacagctcgtgacagtagctactggttttatgatcttgcctcactttgttcacgtgatgtacaggatcgttcatctggcgcttcaaagcatcgctatatatagtttatataaattcctacagaggtaacacaaagcttagacgatgcatacttcgcagcccatgtggcggaattgccgttcttcctaattcctatctctgattatgacctgtcctttcaaatcattcgaacaattttatttagtttggaatttgaatttttttttttcaagctttcacgctggaaaaattccaaaaaaagttttgactcactgacgatatttaaactcatgcaacatcctaccattcaatggatacattaacatgtgtaagtagctgcgttgtacattggtaccatactgtccatctctactgaataaaaaacggtaaatcacataagaagtgctgctaaccatcatggatttagtgaatcatttgaacgacaagctactctttgccattccaaagaaaggtagattatatgagaagagtgtttctatcttaaagggctctgatatcaagttccaccggtcagcaagattggatattgcaatttccacaaatatgcctgttgcattgattttcttaccagctgccgacattccaatgtttgttggagaaggtagatgtgacctgggtattacgggagtggatcaagtcagagaaagtgaagttgatgttaatttacctattgatttacagtttgggacttgtaagcttcaggtccaggtccctgttgccggagagtatacttcaccagaacaattaattggtaagacaatcgtttccagttttgtgaatttgactaaaaaatacttcgcacaattggaaggtgtgcctgaatccgaaatggtcactagggtcaaatacgttggtggatccgtggaagcatcttgtgctttaggtgttgctgacgctatcgtagatttagtcgaatctggagaaaccatgcgcgctgctgggttgaccgctattgcaactgtattggatacaagtgcacatctaatcgaatccaaaaatccaaagggagatgttgaacttctcagaactataaaatcaagaatagaaggtgtcatgactgctcaaaagtacgtcagttgtagttataacgctcctgagaacaaattacctgaacttttaaaaattactccaggaaggagagcaccaaccatctctcaaatcaacgacagtggatgggtagcggtttcatccatgatcgaaaggaaaaacaaaggtgatattatggatgacttgaaaaaaaacggtgcagaagatatcatggtattcgaaatttctaactgtcgtgtctaaaatgattagcacttttcctcaccataattatatatataaaatcttatgcatgggcaccttattgtatccttgtgtataatgtaagttaatatagataaattgatacagcaaaaattgtgacaatagcaatatattgcatgttgtagacaatatttgaagtcagcatagtaggtatttgactcctgcctttcagccctgcatgatcgaaccagtgtccgttcttactgattgtcttcgattctgtctctgtcgttgtggcaattttgatcacgtgaatgaacgagaaaaatccagatagcttacctcaccagagacaccgctggaaagaaccagagatgaacacagaaaagcgcataatgaccgaatgcacagtagcaggttacactatacatatataatgactgattttcaagggaaaatgtgccatgttatattcttggcttttagtcagatcaaaacatggaatatccttgtaataagccagataacctgtaaagtgtggcttacctaccctagcagtacaaacatatctttttttcccataaagatagtaagaacggattttagctagtactgaaatttagcgcagagaaaaaaagtaaaaatatcgaaacttaaacaaaactcttgactgacaaaggacttcttcaaaaggaaaaacactgccaaagtaagacttcttaatccttaaaggggcgtctcacttcccgatctaccaatagtttgtttgatttatataaagcatcatatttgttgtattaagcggtttggaaattttcagaacaaacgaaagatcagcagcggagagagctcagatagggaagaacaacaagtttcggtaaagaaaggtactagtgctcatcattggtggtgttcttatagaattttcctgtgaatcaaggaaaggaattatatccttgtggataagagacataaacgaagggttttgcagtactgcatcactttgatcactggttctggtatatttacaaaagtttgaggaacagaataaacattttggaaagagaacgctagggaagttgttttgagtcaatataccccatcattttatctcatcaatatattcaaatataccatacgagttacgatcgtatttcaaaatggagtttaaccttcaacagacatgcagaccggatttaaagcgtaagttcgaagatgtagattcgaatggagtgtcagatcaacgacaggatactgatgggaagggggaaattctacgaaacaaagcttccaaggtcaatcaaaacaatgaggaaatacagcttccgagtgaaatgcctcagttcaatttctttaaattctgctaccgtcataatccagatattcaacacacttgtaaggattcgatggttttccaagatcaggtacggtcggagaagtggatggagaaaatgaaagctttggacaaggaatcagaccgagcaattatcaaacaaacgctagacaatttccagcatagcaatgataagatacgaagattaatgctggaaggaatattacagctttgttgttttccccagctatcttatattgctgatgaggtaaaacaattgattaagatcgatttcatttcaaccttaccagaggaactttctttgaaaattttaggttaccttgactgtcagtctctttgcatcgcctcgctaacatgtaagaggtggaaaacactagctgatgacgatagggtatggtaccatatgtgcgaacagcatattgatagaaaatgtccaaactgtggatggggtctacccttactccatatgaagagggcaagatacttacctgtaaatgaagcacatgtccataatcaaaacggcaatcaattccaaaatgttgcaaacggcaacgggaatgaaattggaggcggaaagtcactaatcaatcctggcaactctcccaaccaaactgttgccgctagggctaggaatagcaggtactatacgagaccctggaaagtaatatatagggaacggttccaagtggaatccaattggagaaatggaagatgtagaattcagctcttcaaaggccatatggatggggtattgtcattaaagttcaaccacagactgcttttcactgggtcatacgattcaacggtggctatatgggacacaaaatctggtaatttgattagaagactcaccgggcacacggatggtgtgaagggtatttattttgatgatcagaaaatgatcacagcttctttagacaagacaatcagagtatggaactacattacagggtcctgtatatcaacttatagaggccaccaggattctgtgctatcggtggattcatacaaaaaaatcattgtgagtgcttctgctgataaaacagttaaagtgtggcatgttgaatctaggacttgttatacgttgcggggccatacggaatgggtcaactgtgttaaactacatccaaaaagtttcacttgttacagttccagtgacgacaaaacattaagaatgtgggatatccgtactaattcgtgtattaaagttttcagaggacatgttggtcaagtgcaaaaagttattccattaacgatcaaagacacagaaaatttagtggtggatgaaaaaattgaaaaagtacccaacccagagttagaagaagattttgcagatgactgtacaggaatattcgatccgaatttgaaataccctacacatttgctttcatgttcattggataacaccatcaaactctgggaagtcagttcaggtagatgcattagaactcaatttggacatgttgaaggtgtttgggatatcgctgctgataacttcagaattgtcagtggctctcacgataagagcatcaaagtttgggatcttcaaaatggtaaatgcatacaaacttttacaggacacaaggctcctattgtatgtgtaggaattggtgacagttcatttgttagcggagacgagctgggcgaagtgaaaatgtggcattttgatgatatttgagagccctgtcgtagaaccattggcattgttgcaccgattacactatagctaatggtacagaagtgaaggaacaattgtgttcaacatcttcaaaactagcataactaaatacaaaagtttatattgtaacttatttctagtctcaactgctgcctaaatacagaggccacataatgccattctttttcgaacgaatacattactcaacgatcagtttctgaaagttttatcgtgctcggaacaatgtttaaaatcaatgtacctacctggcttcattaaccccgaaaccatcaacgttaaaaagtcaaatgtcgagcatgcgaagttgtggaattcgtcatttaattcgaccgtcgtatatgcgcggaatctaattataagatcgcaccataatgattaagatgatgagcctcgttgaaacgtaacagcgcaccgttttcttcttcgaaagccaaactaacacatcttccatttttcattgtcaacatgaccgtcttttggtttccagattctcaccaaacagcttagaaaatatcgtagtagagaaatgtgactgggaatccttgaaaagaaaaggaaaggaaataataagaaaaaaagggttgtcaccatgagcagacgttttcatgcaaggtattaatgttcctctgtttttaagacttcaatcatacataagtcgggtgagccagtggtcgaacaggtttgtattgggtacttggtgttttatgaccttcgagttaagaataaaaatagtcttggtgttttctactctgtgaggttttgttttaaattttgttgttttaacttttgatcgaagataaaccagatatataacgagctaccccagtttgctcgcattttcattgctttatcatccttaaagcatttagcatttcatattgggcaataagcgctagtgtaaacaatcacttttcgattactagcgtatcttcctgataaacgtatcaagacactagttaaataattggagataagtcagaatagattgaggctatctaaatagaagaagaaatctactatggtctagcgagatgtaccaacgagatgctgtacagaatttacaaagcggcaagtttagctctttgaattttttgaggaaaccacaaagaatttcctgccaggtcgaaacaacagccatgaacgacgctttgaaacggaacacagatctgaataaaagtaaaattattgtagataaaagtttacaggattctcaacatgatgaacacgatcctgtgggcaatgaattggcagggcggctcaacgagaaattaaatttcaataaagatgcggacccatcaaagaaggaagattgggatgttgaaacagacccattgaagaaagaagcatgggaaagcgaaacagacccaagcttaagcatgcaagactacttccctgtatcgaaaccagatgtgcctgaagttgaaatcaataacaattccaacgatgacaacgatgacgatgatgatgaaccagaagacaggtatttggatagtagaaaacttagcgctatattcaatccaccctcaatattacttacacgaagcaaatccctaccaacttctccactagaaggtagggtaagccaggaacaaagacctcctgttttcaagaggtctaaatcggttcattttgctcaaagtgagaagtttgaagttaaatactttagggaggacgaaagtccgttattcttaagaaacgaatcaggagagtacggtacgaaatctggaaagttaaggaaaagcagacgccatagaagccgagaggctgttgccaaagttaatggtgatgatgacgacgatgatatgttgaatatgaagggatcaaagaggtccttggaattggtaaatggaaacttgatccttcaagcacaaactccaaagttattacgattagatgtatttggtgtaagaaaaaatcagttccaaacgtttgccaatggtatatataattcgatgaacactccaaattctggatggtcaaattctcttcactctaataatgcacctttttggaagtatagtcatggtattaatgataatgatgataatgataataacaacaacaacaataaaaatgaagatgacgctaatactactggcatcccaaactttgatttcagctctccttttaatacaaatgatagctttaaaaaagaggcaaatttgggaacctttatttgtcatttacaagaccttagattggacacacaagggcacatgttgattggtaatgtcattgtacgaaacatatcctacgaaaagagagttattgtacgatacaccttagattcctggaaatctcaacaggatgttgaaagtgtatggataacaaaccattgtaacctgaaaagtggtacaggagctatcgatatcgatgtcttccaatttgccattgatctcggtaaaatcaatacaatcgagcacatcgaaatgtgcatactataccaaacacgagaagggtcttcatggatcgatcattgggacaacaattcgggccagaattacaaagtcagtgtccgagtaaagtaacatatacccactccgtgacactcaaatatgcaatatatatgaagacacatcaattatcagaattattatcaatatatatataatttttcataccacacaaataatgtccgagcgatacatgtcattaacagtgacactctgtgatgatatatctaatagtgtttttaaaggaaaacactatgattggattcatgcattttaaacagtggtctatggcgatcgccggcttagcgctgctaaaccctttttggttccctaatagaaactagtaaaaaaatagaacgttcgatgagggatctgcacgtgattatgtgttctaaaggtattccagtgagaaaacgttaaccagatttgtcgagaataggtgtgcctggatcggcatttcccattttgcccgttctcatctaatcctagcaacccaggaaacgattgctttttttcgattgaaagaacagctcggaatcgaaaggaacttgcaagaatgaaggaaagaaaaaacacagaagagaagggagaaagcgcccctgacttcttcttcgagattcatctcctagagtggaacaaaaactgcagtgttttacctaacctctgaactgaaatgcgatagcaggacatcggtaaaacctgcagaggaatttttcggacctgttcggagttagcgacgccattacagacctcaattaatatcctataaagtgtttggcgtatcaatggtatgatggtaaggtgataaaacaaaacattttacacgcctggaagcagatctgccaatttgatcacctggttcattgtcaatgatatttatcgcttctcataaactagggacttcaatttgctcgtaggttgtgcataatatctgtttcccttttttgattttcttctgtgcagcgtttttaatgggtatattttttcgcttttaacagtagctttcatgtagcattcggtagtgttttctttttttatttgggctcttattttcctgccctactgctgcattgtaatattgtacaagacgtgcaaagagataaaaactgactgacattataatagaagcattggcgtcgggaagcaaggaagaaaaacacacaaacactcggttatgaacgacaaatgtgtagcactgaggtgtctggcagtatttccacatctctcaccgtttatttattatagcgggttttcttttagaactgttaaattgtatcacgcttcggaagttaccgtgcatgccatttcctctctcagaaatgttatgaatgaactcgaaatagttaaaactggttccactgtctcaatcaactaggggttaataaaggcagtaagtctttcaatgagggtagttccatttgtttcacagcagtagacgctgtggtgtgtattaccattatacttgttttcagcaaacattttgcagggcatcgcatcgttttcaattttcttgatttttgtcggctttacaataagtaacaaataacaaaaatcgtcgccatggatattagaacaacataggtattagtttaccatctaaacatcgagctttccccctccatatacatcgtgtagataaagggtatgttctttccgtcccagtagttcaagaactcattcgagaattacttttcccttcattattatcatcatcttctacaggtagattccgatgctaagtaacaattacatagcagcacaaccggttcatattgtgtcgcttgggaaactcaacggaaatcaaccaaacaacactgtatcagcgtattagatcggctgataagcctatacaagaagtacgtgaatttcctagtcggtcggtatatcttttcctacctctaatttagatagttgacgttaaaatttatgtctcggatatatactttttctttcagtacgatactcccgtcccgcgcttccaccacatatttttgctttgtaatttgttaatgctttctatctggttctattaattttttttttttttaaatttctcagttaattaatagaagaaactctaagggattattaaatctctcggtttcattaagatgttttgccagattcttaggcataaaagagaaaatcacggagtacctttagagcagtacgcgcagcatgtttatggttacttttgaggaattgatattcatataaatcagattaatctgtatataaatccaagctgtgtacaacagaaatgtcccatatctcaaagggtttccaacgtcactttaaactttctttcgggattagtgaaaccaatcatcattacagttctttctgtcgtcatacgctgagggagaaaatataaaaacacatacacaaacaactaaatttcatagaagtacaatgcaagaccttgaagtattctgcactatttttgcttttatttttgtctgctaccttggatcgcataagacgactatgaacctgttgaaggcagatgtacctcgcttacaatagataacccatggtactgtgatatttcaagcgacagaacttgcaggaatttgatgccacatctttaaacaatggccaggttttctgcgatatagctataaacgcagtatgaacggttctatgttctttcaattccatctttttctatttgtgtgtccaatttaggctgttccaatagatacccttttcatgacatttatgactgaactcgaaaaataatactaatgctaataataatcataataataataataataataataataataataataatagtaacaataacactgatgataaaattaataaacaatgctcattatctaatagcactgatcacccaactaagaaattcctgttgtgttccatatcagctataccgctgatttaattatgtgttgttcaacccactttttttttaaagaaagagtgcccgaaaattaattttaatattcaaaccaaattcatcacctttattataattcaattcttctgttttctttctgaacttctttccgaggttcttctcaaatgtgcttatttcataacgggaggggaatgcatttgtgtgtgctataacaatgcatatgctcttaattcgcggctatgaaagtcaaaatcatgaaaaacaacaacgtatgcaaagtcctacttttgatgactcgtcgatacaatttcaaacaagagtgatatcggattatacactcgtacatttgttccgttttctcaactgaggagatcagctttacaaatctccgtggatacatccggtgcgcctttgcttcgctttttacacatgccttaatgacgttattccacgacgtttcaacacatgataatgccttttttttgatattcaaacctatatatactttgatatataatatgattcaagatctctgtccccatttagataaaattattagtttcccatagtgaatcctgacaaatgtttggatagtactagcacataatgtcaaaatgcaaaaaaacagctgtaaatctatagcgccgatatttacatcagtttttttggagattgttcagtttctatatgcaggttgcaaagcatgtttatagtcactctaatggatgttatttgtttttattatatatatatatgacttaccacaggttctcaaaatatctcgcatgagtaccaaacgaaattatgaccacacatttttgaataaatcgtcatccaatgacaaacttgatccacttctgctatcatcaactgcacgcggcaccgcccatggatttgatgtcaactttcctccgcttgataaactattgctagtactcatgtttttggtaggaaggtgaagtgatgattgagatggagattgtgattgcgaatggggagacgtagatttgcgatttgcgtacagtgaaagaatggatttctttaaatctggtctatccggtggtctgtagacattcgtgtttgtagcagaaggtttctcagaggatatttgaggtacgtttttgtctgtaaccacagaattcagattcagccccagatccaaatctagggagcgaggcgaatctgaagaaggactatttctcactgccgctgctttctgggccacacgatctttagcttcagcagtatgcttgctagacttaacgtccacaatgggatcatcaccaacccacttttttaattcatatttagtcctaataaattgtccaattttgctttggtctggtacgtaagtgcctccaccaagtttattctcgtaatattcgttgaatttcttattatttccgaattccaataccgcttccaaatgttcctcggtccatgtatccaaatcaacactcttcactttactaatgtgtgtacccatagatctgtgaaaccctgcacatttaatgcacacgaaaacacccagtgaccacgaagcccaacgtggatgagttgcaactttacaatcaccacatctgttattttctggatcacgaagcaaggtagtcaatacttttttcacctccacactggtcattcttgaatagcagcaattgacctaatattattcttctatcctgttgaaattgtttaaaatccagtccgaaaagatttaaattataatttcaattcttatgacggcctttaatcagtcaacttgaataccttcgttacgagtacaccaataatcaaaaaaaaaaaaaaaccaaggtgcacaatatggcaataaaagaagggtttcaattggagatataggctctcagtttcttccaaaacagctccagaacctcagtttgcgaaacaggatccttaacagaattagcagcaaattactaacttcatctgtaaagtgcataaacaagaaaagaatgattgtctattgtttaattttgatgatacgcttttttccactttcctaactcaaatcccataacaaaatttcgcatgttaaattcggcaatctactcatctaattgcaaaaaaacgctttttagttttgttgcaacacacaaaagaaacgaaaagaaaaaacgcattctttgattttattgtgcgattacaccttctttatagtccatggaacagacatatgttttttttatcgatttgcatcgatcctttttttcctctcaacatacataagattcttttttatttaagaaaagtatttaatttcgcaacttatgtctaccttttataatgtagttgaaggaggaagactggtgagttccaagactggattgataacttatatgcagagcacattttgccgtgagtgcatactgtgtttgtgtctgttatttattttacatctgttcgagtactattatacaggcaacaggcattcctccactcatcacagatctttttcttttccatttgttaccgtccaattgttacgtatatcaccagctgtatctccaactagagaatataaaggaatcactgtaattactgatattattaccagggggcccattggatgagacattgattgcttttactgttgttttcaagtttattattgctagctctgctatatcgcttccacgaggaacagtactatcaactagattgacccattcaattttttttttttttttgggttcaatattataacaattgttttgtttccgttttgttgctttcgactaatcgatcaacagtccgtcactatatattcgtggaagttcaattgattggtgattatttttgtgtttctgcttagattttctgagaattttattctttttttggtacagcattcatagcatttcatttatttaaaatgagagacccgctaataactatggatgaagtagcacgacatagttcgcggtccgactgttggaccgtgattcatggcaaagtgtacgatataaccagtttccttcacaagcatccaggaggtgctcaagttcttttgaaatacgcaggtaaagactcaactctgcaattcgatgacattggtcattctatggaatccctagcatatgacttagaccctggtgctttaaagggaacattatatttacctaattccaaatcaaatcacaacagcgacaacgaagatgattcttcacttccgtatttcttgagtgcaagcttcctgccgtcaagtttactttggatcactagcatttatcaagcaataagaaaattctttttgctggaaagagacactaggatatggttgttcagtacaataattttcttctgtgtgcttacattaggatttattcactggggtcatgatcataatatcattgataataatgattatggagttcccgcttggatggattgacgcaactaaaaccaaagtctacgaactcttgaaaatgcggagccaaccgcaaagataaaacattcagccagttattcgcgaaattcacttcaattattaaactttttttgattaagcttctatatgggaagccgcatatcttataatggatcaattctggcaaacagtgccaatccatttaataatattcgagtacccacaaactacaacgttactataccatagctttctcatttcctctcattttgtttcatcgaatcattatcagtgacctttctaatgttaggagctattggacgtttcgattctgttcctacttcattccatcattgcattatattttccactacctttgtcacttcaattcaaaacttcttaaagttagccaagctgaaaagcgataaaacgcgaatcaaactataacacagctattacaatacgtacatccgcttaagttataggtataacatattgaaattacaaataaaaatcaggagaattaactcacaattttatgttgttctttactgttccattactatttattcataaccattatcataactccatttcattattttgtttattctttttcaatgctagtgtagcccacacttgctccatctaataaattttgtttatcatgcagcatcagcgaacaatttccattgcatgctcttgaatcaccccgcttaaagggcatatacctgtctaccatatagttcccattttcgtaaatcacgtgaaaatggcataattatcccatcaattttccatcgaacctcacagttctagaaaatatattgtgaaaaactagaaagattttgacaaaaagtaattgagtcatttggtttgaatgaaattcatataaataaaggaagctccgacaaaaacccattagcacattgtcctcagctgtgtgtttacaagactgctataccctttggaagtagtaacaggccttttctataaaataacttaaagtatcgattacgtgatgattgaaactagtaactgggttgtacagaaatttggtggtaccagtattggtaaattttccaagcagattgtaaatgaaatcatcaaagtgtactctcaggaatacgacaataacgtggctgtcgtgtgttctgctaggtcttcgtacactaaagctgaaggtactacttccagattattattggcatgtgatctagcgtcaaacaacaactatgaatataagaacgttcttgatttagtcgagagagatcatgtcgcaaatgcagaagagtctgtcaaggatattaccatccaagagactttaattgaggataccaagagagaaataaatattgtcaggagatatctggatgcctctcaagtcttgggtgaggtgtctacaagaactttggatttagttatgtcattgggtgagaaactatcctgtttgtatgtgactgctctttgtcaggataatggtgtcaatgcgagatatgtggatctctcttttattgttccaagtgattacgaatgtaaggaaggtactctggataatagtttctacaccttcctcgtcaccgcttttagagagaagctatcgccgatcttaaaagaaaccgagaatggcaccaagatcattcctgtcattactgggttctttggagtcgttccaatgggtctacttaatggtgttggtagaggatatactgatctatgcgccgccttgatcgccgtcgcactaaatgctgacgaattacaagtatggaaagaagttgatggtatcttcaccgccgatccaagaaaagtaccccaagcaagactgttagacacagttacacccgacgaagctgctgagttaacttactacggttcagaagtcattcatccattcaccatggaacaggttatcagaactcacataccgattagaattaaaaacgtccaaaaccctaagggtaacggtactattatttacccaagcgatcaagccaagaagggtgaatccacacctccacatccacctgtagcgttaacatcctctatcttcgaatccaaaaagaaaggcgctacggccatcactactaaatctgatattgttgtggttaatatacattctaataagaagacgttatctcatgggttcttggcagaaatgttctctacgttggataaatataaactagttgtggacttgatttctacttctgaggtccacgtctctatggcccttcctgtacctgattcagattccctaaaggctttacggtgtgctgttgaagagttaaagagactaggtacagtcgatgttattaagaaaatggcaattgtctctctggtcggtaagcagatgaagcaatttgttggtattgctggtactatgtttacaaccttagctgaacaacatattaatattgaaatgatttctcaaggtgctaatgaaattaatatctcttgtgtcattgatgagagcaatgcagtgagagctcttcagtctattcatgcaaaattattagattctccgcagaatgaaaattttgaatcagcagtgaatgaaaggttggaacaaatcaagcaaatgtctttatagatgttgattagatcaatcaatagaccgaaaaaaataaagaaaggaaactattttccatagaaagaagtagtttatgatgttcttgtgataggcatttttgcacaaagatgttctttaacatagtttaataggctcttaacagtacgtttggatgatataggtgccggagctagagtcttttaagtaatgatacaatatagaaaaaaaaaattaccgacattctcccgtcttttataatgaatttacaggttggataaagattttacttacatcataatactgaaccagcgatatgtattctgattgtcttaaaatacaaagatttggtctcccatcttagaaataggtttagctttctcgtaacctaaagtgacagcatttctcttaatagatgaaaccataggaggcggaccgcacaccaaaagttggacgccttcagctggagctggaagacgttctttcatagtatcaacggtgatatacccaacaccaccagtccaagcttctggagccttatctaacaagtaataaaccttgaattgatctggttttctttcaacaaatgcgtccaattccttcttcaaaaggatatcctcctcagtttgattaccatagactaaagataccttggttttatcggaatcgttggcaaaaattgatttcataatttgatacattggagcaataccagtaccaccagcgatcataccgatttcttcattcatgttaggttggtaatggtagaaaccctttgggccacgtaccttaattttgtcaccaatgttgagctgtgcaaaatgctttgaaatgttacccttttcgtaggacttaattaaaagttcaaagtgaccgacggcgtccgagtccaacgaagttggtgtataagaccttaaaatatccttgccattgatgtttgcttgaacagaaatatgttgaccaattggaagccctaatacctgtgtagactttggtaaaccaaatctgtaaatagcagtattatgagtcaacactgtctttgccaccaatggaaattcctgtaacttctccttatctagcactggcttatccttctttgattggtattccaaaacaacggcaatgatagtgcacagtaacacaaaggtcgcagtgaaaatgaacttcccaggaaccatatttgaggttaggctaaccgtcttattttaaagtatacactatatcttttcaaatataacaactggtacaatataagagcgtttattgcccaatgatcaatgctatcgtaccttgctcatcagattgaatcctcacatccaaaaaaaatcttattttccatgttggccttcattcagaaaggaaacatttaaaccacactaaagagagggtaaggctaaaaaactacttaggaaagaatgatgggatggacagaatagagtgcagtaacctgcgctagcttccctgcataatagtacttaagatattgaggattaagtgtgttcaaattttattattttattctttagctccgttattagttcttttttgctctgataattgattggtttatatttgatgttagatgacgagaggtatttgaccaagttctcaatatcttccgatgatatcgattgaatatgatcagagttcaatagccattcacatgtctttcccataaccgattcaaattgcgggaaagtaaatttttttggaacttttgtctgatgttcaatttctaccacatttagttgggtagttatgtctcttaatgttaggaaattacctccaacgataaacgagtcctcaggcgtatacacggcatgaatgtatccacacggaatcatgaataaattaccctcggtcaattccattgcgatacctgcttctagctgatctcctaagaaaatgtcattctgattatcgttgtcacaccattctctgtatttcttcaagttgtaatctgtcggtgggaataagatgaacttctttgatcccgagattacattataatagacactagttccagcaaaatccaaatgaaagtctgtatatgcgttacccacggacattaatatgtatttggtaactttcggccgttcgatgtcggtctctgtacgtccaaaattccaaactatatcaaccaaatcgttattattcacagcattgggacgtcgtatcccatctttgaaactttctacatggcttacctccagggatataacatttctaatacgatctctatcggaagggctagtatgagaatagtactcgttccattgagaaagtgtccatttctcattcatttgagtctgaacatccataacgtctaatggataatcatcccccatgatttttgttagatattccacgttaagtttaacatgatctttcgaatcgacaagacctagttcattagctgaaatcacatacataccactatcggcaggatcggatactcttaatggtactttaatgatttggaaatcagattccaattctgacgagctgatcgccttaggatctttccacttttcaaagcatgcgaggaaggcttgcgtatgtggatgctcatgctttaatcgtttatcattaccttcatttagcgcaatgtaatctataggtcttttatttctaagtctgtttctctttgtaaaagcaatatcttctgtccccactgacacaccgttcaacttcaacaacgcacacttcgattcatcatgtagtgtgcatttaaaagattcaacgtgcttctctttaaaagctaataattgtgaaggattctctaacttcggaaccacaaattgaataggcacacacgttaagtgacaccaaccgtcacagaattcacaacctacccatattggctgacctttatcctccgaatcatcctttttgcaaaaatgacatttcactgtaccactagtcataatcaacaaagcaaaaaggtaactaaacagtgtaatttaattctgatcgattcaagataaaggcaacaaatatgtctgcttagctttatgcctctctttattccttccttttatctgaattctgtgttgaatttcgcttgattccaaacgaaatatcaattatcaaaaaaaactaccgtcataaaccactttaagacaaggagaaacaagtaacacatatttcaagctataattgctagtacagaatctcgctcgaattaaaacttgctacaagtagctacaggacaaatagtacgcgagcatcgaggaatctcgctctttcattaccgcgctcttcaggcgtttttcctctcctctgattcttaaaaaatcatgagtagacacaagggcaggtccggaacagtgccgtcaaacacattatcagcatatgataacaatagagctatagtagataattctacttcaaaaaaaatcaataattctaagcctcgtcccataaactatgacctatcaagatttacaatacctaaatccaaagttacgaccatacttgatgacgatgatctcaaagaagagacaactagttctactctgcggaatggagagagcagtaccgctgctaatagatcattgttagagtcacataatgatatgccaggtattcttggtagcaatactcaccaacaaccaaatgaaataacagaaaattttacaacagagggcacagtcaaaattgtcagcaaagcatcaaaagaccctgtcttccagctgactacagcattaagtgttactctttcaaggggcaaagatatgtcaagcccagtgttacttttccaattcatgaagaagtccaaacccatacaagggttctcgtttaccttaaatgatcaaacagtgaggttttggtatggcttcaaaggtgaaggtttcggcgtaatattccccaatgaaaaacaattcttgttgccaaatgtagatagaatcaaaacgagatgtctttcttggatgggttcattaagttcttcagagtctgcaaagtttttacagctcatggaggcctttgaaagagaaatgtgttttacgggtgtagatgtatcgtcagaccgaatattcaaagtcaagaaaagggaaattgatgcaatgcttaatgaatataaggcttctcctagtactggaacaaatcaaatggtcctttttcctgatcggtacaaatcggataaactcttcaataagtgccccaactcgtcactgaactctctacatagaggcaaacgcgggtctgggaatggcacagttatacagcttcccgactacaaaccgctgacttcatatcagaaccaaacgccagacgagacagtatcgcaagagagtttctatgggaatcagtctacctctgaaaaaaccactgaacatccaccattcatttcttacgtttctaatttgaggcgtgtcacaaggtccatatctgataacaaaaaacatggcgatgtacatcatacatctgatgaactcatggaaagtgaaaacccggagttatttgaacccaccttatcttatactttcaatgatggttccaaactctcggtaactaaccaggacttcaaatgtttgtacaataatgattggataaatgatacaattttggactttttcctaaagttttatattgaagaatcgataagcgacaacgtaatatcgcgatccgaagtctacttattttcttctttcttctacactaagcttgtaagtacagaagcaagcaaatatgaaaacgtaaagaaatgggtaattaactcagatctgttttccaagaaatacgtcgtagttccagtgaatatgaattatcattggttcggatgcataattgtaaatttggacaagttgaaggtagccatagaagagcagttaaccaaaaagcttacatcaaaaggaggtaatcttaaatcaccttcgctctcaaaaactgaggatgaccgaaactcaaatatagcaagtgctcctacgaatgtcactgcagataatatcgagttacctactgtattccttttagtctttgattctctacgacaaacgcattcaagattaatggacgctgtgaaagaatttattatttcatacggcagagacgttcataattacgatattcaaagagaaaagctcaaagtaagaacatgccttgtaccacagcaacccaatatgagtgattgtggtgtccatgtgatattaaatactaagaaattttttgaaaaaccgaaagaaacgctcgatttgtggtttgcaaagtcgtcctacaaccactctaaactggtaaacgaattctttgaaaagaaagaacgccgttttgcaaggaaaaccttaagagatgtcttattacttctccaaaagcaacaaatagccgcccatgggatatcattgggccaagaaaagaatgaaagcatagaagagaatcatagtgatttggagattatagaagattttgaggcaaaagagatggaaaccgacactatggaagaaacaggagagaccaatcatccacctaatcataataatatgcaatgcactccaatcgaggcaaatctgaatagcaaagcaaaagcgcctacaccaaatgtcgagacttccatgtacttcttgaaatccacaccatcaatcgaaagatgtactccaaacaatgataataagcatgaggaccaactgattatagttccagaatcatcccaaaatagtgttgcaaataaagatattaatctcggaaataaatctgaaagagatttttatcagtctgcgcttttaagtgatgatgaccatcgaaatgaatcagattcatgtgccgatatgatttcaagtcaaccaccagatagggcaaactttagggatcgatgtcctacggcggaattggatgacattgaagattcaacttctgataatgaaaagtccaaggtttatgacatttcttgttcacaacagagatgtaatgtgccagtttcacctgggaagctgttgaatgagaagctgaaaactttgagtaccaacactgcggttacaagtgatgctaaatattcgaattgtaggaaatatcagaccgtttcttcgttgatcagacagtcacgtgcaattgtggataaaacgagagattctgactctagaattacacgctctgatgatgaaaatgaatgtggcggaaaatctactgactctataaggaaacaactctccaatgaactgcgagaatcaaataccgtgagtttgggtaaatcatcgtcatctgacggtggcaaactacatcaacctaacagctgtagtccttctaaaagctcctctcttccgtcagaggatttggttgaagaaattgtggaagtacaacctattcttgagaaagttcattccaacagaaaggataacaaaaggaaaattgtccatctcttcagcaataaagaaaataaatcttacggcaaaaatcccaaaatacccaaagccagctttttcgatcaatttgcatctaaatagctacatatcctgttttccatcattttacttcccagtcgtaagtaataaattttaatggtaagactagataaaataattcattgaataaaaaaatttcgctaataaatctataaagacatcttgactgatcaaactattcttcaaagttttttagtatccttcctcttgcatacacttcgtctctcacactttgagataaagaattgtaaagcgacttggataaaattgagctcacagttaggaacgccgaggaaatcgtcactacatcaacgtagtagaatgccttttgaaatgtagtcataagggaatgatctgccgagacagaaggctgtatgaaaatgaaataaacaaatggtgcccatgaagaggtgtaaacttgtttgtgggtaaggaattcaaacatagaaaaactatattgcagagcaaaaggtaccgcaatcattgcaacgaggtacacaaagcatatatccgtgaccctaatgagtaatcttctgaatcctaatgttttattccgcttcaaactgcactgtaccgcgatgtacgccactgctgctacttgacaaaacaatagagcagctattaatgagtaagctgaatagccgctgtattctgattttgatgcgaggttcgaaaggaatggaacaaacgatatatcagggcttgtgttttcgagaacgtcgcctttccagtagaaatctttgaagtaggtgaatatgaagaccgaatgataattgatattcaacttgaaaatgattggcataaagtagaatgtaaagactggatacaccattgttacaaagcctttgatcaagttccaaacatcaccttcagcaatttccggtactctaaattcattggctactggattttcatcattttcgggaatattatcatcattgtgaactatatgctgatgattatcgtcgtttggaccgttatttggaacatccccattgtgttcggcattaacctccaatattctgtcatttagatggatattatttaatagatgtgcgtggtaggatgacaaagcgagagacaaaagtatcataccagaagaaacggaaagaagatttaatggttttacactttcatagagttcattttgaaatttcattgctggggggataaccgcattcaacaataattgcaatccagtgataatgggaagcccagcaaaatttgagattaataacacagcagtaaacaaaagggaagcaaagatccatatgaagacaattaacagcgaataagtgaaagtaaaatgcggagggacataaactaccttatattcatcaaattccgtgggctgtttttctaggtagccaaattctccggcatttcgtttctgtctttctttgattttttcgatatccaatggctttagaagtttgtcatccttagtaactgggacgaacaacaattgtgcatatttttttgatattatgtcgctcgcaggtacgcgcatcatggtgccatcggggacaaaatatgcgtgaacatcaggaatagttttgaaaagagtataggtttcatcgagcgattttggatgagagtataattctaggttggacagttttgccttgtttgggacgaaccatttatagtaaaagttcctataaataacatgtcctctctcagttggtgaatcttttcctaagatgaaagaggaaagtcttagttttctgcagcatatattgaatacaaagacccaatattgtctaacataagcatcaataactctattcttcgagagaatgagatacgttccagcaatgactgcaatagaaaacatagaatttggttttatgagagttgacaatccatgcttcataggtaaaagttccgaatgtaaaatgtaaggaaacaaaagtctcgtatgaaatccaaaacctactaaaatgaatgctgtatagattgccatcgacaatgcaagtctggagagttgaagtttcattgggtatatcaaagaatcctgtaatagcttaatattaggatcatctggtgatcttatgaagaaaagaacacccggtctgataatatattgtcttaccatgccgacatattgagcaaaatgatacatataaacagtaccaatcgcccaataaataataaatgtcataggcggccaaaaggaacaaaaactcggtacgaaagtcaagctgctctgtggtaataatagcggtgagatcagtgacacatcaatcaaaaaccccgctaaaatcggaaatccggcaagttcaagtgtaaacaaccctagcactttcaatgtgcacttgatgatataggaaaacttgaaaatcgttcttttcaaagaattctttagaggtagcttcttggaatgccctctagataacagttctggtatacagcaacaaagaactatgaaagtcgcatatgtactggctggcgccaacattcgtaccagcatcgtatgttttgctgtgcctttcatgtatccctgatagtacgatactattggcattaaaactgtcccattaatccaattttcaacgtaggataccaaagaaaaagtttctataagcttttgattgtattctgggatatttaacctctctgctgacactattactccattcagcattataatcacaactctaaaataaatgaaattcaacagatatccgacaagtgtggctaaagcgtatgaaatgaaaagatatccaccaatgacagaaaagactaaggaaaagtagctcggtaaatatttgtaatcaagatttaaattcaagatagccgtaggttgaccatcttcattctctagtacaaccgctggttgagcatttattccatcttcttgtacttctccttcaacaggctgaggtcgtccgagttgagcatccaaccgcccatcgagttctctttgtgcaaagtgtctttccataatggattgtgaattaaaagtacagtcgattaataactcagctaattggtaatgatatgaatatgttgcagaagaaatatgatattgtgatcagaagaaaagagtaatgcagggatctaatgcggaaaactcaagttgaagattcagtttctatgatataattattcaacttcaacagctatacaattgtagcaaagattaaatattgttaacctgttgtacttagttgtgaaacgagatcagtcgacgatgtatatactgattgtctgcgcccatgttgaaatttccttcttcaaatttcaatttccattataagccgggtaataccaaattcatctttgagaatctaatgggctagcatgttttactaaagcaagtgaatgatttgatgggacaacgagggaattatattgtatatagaagtttatttcgaactggagtgaaggctgatgcaatgtttcaatatgaagattatcaatatcgtaaatatttaaatgggggattatagttagttggcaagctgaggctcatcattattttcgtttacgatgaaattgttctgttcttgttcgtcttctgaagtatcatcttcatttggatcgtcttgtcgttgtctattgagggcatttatgagcatgcttatatcatttggatccatatttggaaatctttctcttaatgactgcatggccagctcttgttttgaaaatcttggtccaatcttatgcaagatcatcttattgaaaattggctctctgactaccatatcatattgtaaatatgcgatagcatgcacgatcaaaaccatcagaatttgtaacaacgaaaatctgtaatttatcactagttgatataaaatatccgtagttgttggattttttggtatgtttctttcaaagccataaatcaaattgatataccatttgttatttgaaggaaatgaaaaatcatccacagtagccgtatatagcttcccccagatattccaggacaggggaattccaatgaagaaaaggaacgcaatcaatgtgaatttgaaatagtgatttaatttgccaaagattttgaaaacgctatgtttcagaagaagtagaagtgggatcttctctggcattgattcatcatacaaagtttggaacgcgattggatgattacaaatcgaacataccatccctgcaccaggttttgtaacatcgacatgttttgactgtagccattcgatcaaacataattgatgaatatatttgatggagcctttgcacttgcatggatggaacaacggattatcggacgttccttccagcatacaaatacggcaagttggaaaattccccgcatgcttatcttcgtagttgtggtctccaccattcatactggatgacattttttatcaattagtaaaccggtactgcgaagttcaaatttgaaacttggataaaaaaatcttgtgtctaagaggtcgtactatggtttcaactgtgaaaaatcaaacctgcaaagagatgattgggctggttattatatacaagagaagcaggctactctgagctgtttaagtttctctatgccataagaattgatcgttatgcgtataagttttcaaatttgaattgcattgaaattgtctgtaaattacagacataaaaaaaaagaagtttaaaaatctaggattcattcataaaatagacaaaaatggaaagccctgtggggggctcgaacccccaaccttgtgattaagagtcacacgcgctaccgattgcgccaacaaggctatgtaaatttgtagattctgactcgccgtatggtcaactacattgtccaagtgtgatcatatatgctcattccttccttccttccttctttaagtgatttggtaaaatgttgtatcgagtaagagatcttagagttgcatgtgcgtcatattgtgttagatacgttcatttgtaatagtatgtgaaggttttgcttttcctttcgcatcatatttcatcaaccgaatttaataacacaaaagcagtcaagtttcttaagatgtcaatttatatagcataacgtagaattataacatagaatcggcataaataccaaccattatgctaaggcgtgatcctacagttttatccttgacttccgatgatatttccgagctacaagaacatttagaagagtacaagctccaacgcgagatacagacgcaacatcaagatcttttgaaatcatctgcaaaaatgagtagattagcagagatagaaggcatttctaacccaagtgcgacacggaatgatattttatcacactcattgcataagatgacgccacctcagcgatataaacagtctgcatcatcagatcctcgattcattgaacaaaatagtacacagagtacacaggatcctccaaatcccttttacacgtacaatcacaatgataactgacgtcctaatgtgattggtgaagtgcctatattggctatcggccctgtatctactcccgttagttattattgcaaagtcattatattatgtaattccccagtacatattatatatatgtatgcgtttaagttaccaatctttatcaactcacaaactgcgatgaaggtattctttgaacagtttcctcttagcatggatgtcaacaaatgaaggaaggtagtttatttccccataaggatcattgtttatcactacatctgtactggacgccttgttcaattcgataggtttaagatactcatctgtctcaattattcgttcctccccacgaatactaaggtacttaagcttggattgactgataaatgtacccaaaataaagaataataacccgcatagtgcctccaattttacgtcatctggtaaacctggagttttagcgtctgggttctctagaatgatatgtttcacaatctgatgaaattcatagctggacacaccagaatgaataatctgtatccacgctataaagtagaatgatttggaaagtattgacattgttgattccaagataaaacggtgaatagtagtatttaagtaaagtaacaaagcctatttatgttagatctgtccagttgaaccttatactacctatattttgtttggtattcttgaataacctttccgtttttttttttttctgagtgttatagagtttccgacaagagaaactatctaggtaaaaaagagagatagcatgcagtactgacacacagccgcatgattgaggagagcttaggttatcgatagccatgtaataggttttatgtattatgtttaacacaattcaccaaaaaaaaaaataaactgatttaaatgcactcgcaggaatttcatttcgtaggatccccaataagattagattggtgatgaaacaatggggtctgcagggtgcggaggcgaatgaactgtttcatcctgagtgaattcctcaattggttcaagaacttcatcatattgttggggtactggttcttggtttaatttggctgcaggatggctctcagcgttatttttcggttcatcttcgaaaaccgtttcgcttactacactctcaaataatggccctaatttctcttggtttaacccaattcttgtagttaaatcgctatagtttagaattccaagtttgatgaggcctttcaatttaatggtatagatacaaagctccttctctggatctccatcaacatcgactaagttgacagcgccataatttacatcttcatcagccactcgatctagagttattcccaaaaattttccaagacaactctcaaggtagaggaaaactttgtggcaaataccagttagatcttcgttagagataactgaatattcttgccttaacgcccttatccaatcggaatccttttctgacaaatcgagctcaaacattttgaatgcaatgataatatctaacaatggagagagtattacatgaagcacatggaatttcttgtcgtgttgtatttcagggttagaatcgatctttgaagaaagattcagcaattcgactaataccgttctaatttgattcagcgtagtatgtgaaacagctataggttcttcattatttttgataacatctctccaagttgctaaattccaagtaactattgaggtgaaaagcttaaaatctaggacagatatggcatccgaatcaatctttggtagtaattcactcaacggcttcaagaatttttcaacaatgtcatccaaaagcgtttctgaaatttcaattgcgaactccttacccaaaattacaagtttgttaacatattgcagatataatgttgttattgaattatcagattttatgtcaaatgattccataaacttcttgaatgataatgtcacgttaatcagacatgacttccaataaccagttacctctggtatttgaagggatgccaaatatggaattaaactcttataggttttagtaatggcatttgcgttgctcaaaaccactggagagctttcaaatcgttttgttattgttttattgatattaaaaatgacatcctttgattcactggaattccattcttctgtgtttaatagctgtattacatttagtagttgagtatatatctgatcagaatcaagattcattttcttgaaaagatcttctaactctggaagaattaactgtgtcacggcttgtctgtcctggcctttgttgtactgtatgccgcctgtgcataagccgcccaacacagtggcataaaataggacattgttatcagtttctggtaggaacaatttgatatcacccagatcattggaaaaatcatctgcatcagcatgaattgtgctgccatcgaaatttccctcttcatagagtagttttgatatagtttcaattaagttgtaaaacttgggggataaaaattccgccgcttgctgtaagagtttgattttgtccggtggtacttttgcataaccttctaaattactagtggagttgatatgatttaacaatgaattgtgtaataatctcattaacacacccaccttaacaaactgctcttccgttaccgaaattaccggaaccttaaacctttcattgtttattagaaactcttccgttttttcagaaacaatgtttgccaagaatttggtaacctcgttcaagaatttaacgtcccttgacgaagaagatacttttacttcatgatcaaaaaagatcaagctaatgatgtctattatttcatggtcatccagataacccaacccattaatcgacgaaagtacttgaactgaggttaatcttacttgaatatcgatgtctctgccagctatttctaacattcgatctttgaatctttcgaaaaattgtcttagggcagcgttatcgacagtatttttgtttctcttattggagaacttaattaggtcatgaagggaccttataacttgtaaccggactgaattactgctatcagatagcaaccaaccgaagtatttgaggaaggttaccttaaaaaagtagtctggattgttttcaatccaatctaacaagtaggatatcgcaagggatctgatattttcatctacatctttgaaacgatgaacaaaacagagctttattatgttatcaatagtgttttctatcacagttttcgtagcttcagcatcagaaatagaagattctagcgtctccatagttttggacttgggctttttcttttttctctccagtgtcaactgtttcctcagtttaaataacacctctgcttctaagctggcagaagctcgtgcgagagaatcttggaaacagaagatggctttagctgaaacatatcgcaaacatcgtatttttgatactgacatggaaggtatccatgtaagtaagtcaataattaatggatttgtttcgatcacaatctcgtcactttcttctttttcattctcaacatatatcatctctttctcaatggctaggtccattaatgtggtcatgaaaatgttaaaattatcattcaaaggacggaactttgccttcttgtgtgttgccgatagtaataaatggaactcatgttttttttgctcatggaacataatttgtatttcccctattgtttcattcgaagagtcattattagctacatcgtgttcaccaatatgagtgaaacatccagaacaatctaataagaaatttatgagattcgctaagctgacatttcggttatctatataggaatccaaccagtcactggcaagttcttcgcaagaaaaatcgtcggagctgcttagaatttcaaaaagctctgtgggtttgaattcattctgcaatgatatgtatgcttcctgttcttttcttgaaacagcactggatatattattagatggtcggcctttctcgttttgttttaatttcgttctcttgttgcttgcaacgcgcctacctccggaatttggtctttttctggagccaggggcaacatagtcgtcatcattggcgtcatcgtcttcttctgaactactagaaccttgtgataaagcttcttcttctttctgattatccgtgttttcgatatttattcgatcgtcggtgacaatggatcctatagtttcgtgctcagagtccgattctgatccagattgttcactataagaggatttggtccttatcctggttgaccttctcactggcataggtagacagtggaacgaggctgaatggttctagtaagtgactgttgttgttaatgtactatgagtgagagctgtttttttccttgatttgttgttcgtcgcctctttttttttactttcatacatatagttttttagatttacgcgacgcgtttttttactcgaatccatgtaaaatgtaagtattatattttggcctaataacggcagctgtgttaagaagtgaaacaacagtgttacattgttaaatcacagacctatatcaatttctctatctaaagttaaatgacctgttttacgaagacatccatgaactttatctaagagcaattttcattcaaatgagatgacttttgtatgctttcatttgaggctaccaaagcatgggaagagagtgtgttttgaagcaatcgtcgtaatcgatttaaaccgacagactgtattacatcctgagaaaaaaaagaagttagaggctaaataaattaaagaagagaaatagcacgaggtttaaatagtaattattgtagtttgatgaatatgtgttcagaagatttttactggatagaagaagttgagcaaaaagcagtgtatattagcgtgaaaggaagaaaaatcaattagaaggagaataggtaaagaagaaatagcataaaattaaccatcaacgtttccagtaagtggttgcacgtcttaaagttgcgacgagtccgtgtatcggattatatgaagatggatatttggcattttgatcagagtagcttgcctgtagtagagtttgttgagattgttgttcgtcaatatcatctaccaaaatatcatcaattgtaccttgtgttactctcggatctaattccacgtcctcagatgagcttaattcacctcttgaagttacgtgtatgtaatcttgttcgctacttggcctagtgattgctaactgatcgatctgaagatctgaaggtgacatagaagatctaaaaggttttaaatccaattccacatcttccattacaatatcagcaaccatttcttcagtctccaaccaagccttgcaatggattaaattgttttcgtgacccatatcatctatatatttatcgaaacagctcaaagctttccaatgttcgttgttgacaacgaacttacagacgaacgtttcactatagccatcgtacggcaaatgggcaataaagtagcctgtgcttgaatcataattcaaggtgtactgaccaggattccaattatcgaaatccccggtgataataacatgatcatctttagtaaatccacatgaagcgggatcaattctaagacaaagctcttgacaattttcggacattattttcaatggtaaagttttgatggatacggtggctctggaaaccgaatgagcaaagtccttgtagaccctcttatcgtaaatatttctttgagtagtttagtatttttttatttgtctttcagggacaagcgtctaattttttcaggatcaaaaatatatatgacagcgagcaacccttgaaagaaaatcagtagcagatataagtcctaaatactgtacagttctttggctgacaaagtaatgataactgctttataccgttgatgaatggatacagtaaactgcttcgtgagctttattatattttctgaggcctttgtacaaatgtgataatattatcccagaaataatgaggttcaattattggcttatacttttccccctaaaacgtgaaaacagtactgacgactttcgatctctaaagcttttagtagcaactgatctgatactatctatcgggaataaagcaaagaatttaatggcaagcgcagggtgaaaataccagttcctgtaccggtcagatcctaaaataaactgtttcctctaaagtaaacatgcatcccttttatataatgaggcctgaattctgattcgatttttgatgttttgattttttcactagcggtggcactgaaagcgtaatgattaaatgaaacagaaagaatgtgacaccgttgtcaatgacaacgaaatagtatgccggaaatgaaagagacaaaattcgtaggttattgaggtcaatttcttacgaaaaccgattttctgtacgtgtaggtcaagatgagttaccacacacaatcaattttttgattgtgagtggttataagtatatatatatatatatatatatatatatatatatatatgttgcttcttcatcgtttctatctcattgccttcctaacttgcagtgcggtaaatctgtgcggtagtggttcatgatatgtaggaaaaaaaaggaaattcaaaatgcgaaattacaaaaagaataacactctttttgtagatcactcatattgaacctcatgatgtgatttttaagtaatacagaaatgtatcagtcgttcgacgccgtataactcgatccaaggtgtttcttatcaagtaaaaaaaacattagtactgtttatgagagcttctgacatgtgagagcttctgacatgtgtcaaaaaaaaataaaaaaaaaccgatgattgtcttgcctttgtgtctggctcgaatgcagtaatttcttcagcagctcttcaatatactcaaaagttaatgaaagtattctgtttcacggctctcaaactaaaattttctcaggtacaaaataggctatcttggttccgtttacatgcttaagctggctttgcattattgtgtcattggtttaattaagagtttctctaagttaagtagatagtaatttgcaaaagctccacactatttatcactttaaccataactataactacaactacaattaatgtcagagaataaacttagggtcgagaacgaacaagtgcagaaaggcgattatgccttggatcatgaattggaaaatgttacaaatgttgttgataccagagatcttggaatgataggcgaaatcattcaaggaataattgctttcttaaactcacctgcctttgcgactatagtacaaattatacaacagatagtagagctgattattggtgccttctctttggtctcatttttaggataccatggattccaagatgaagttgtgaaacaatatattagtaccacgtctttttttgtcgcaacaacacaacacggttcgtccttattcagtaacggaattcatttcatgatattaatccttgacttactttccaatcaggacttgacaagtaccgaaattgattggaaaacaattatcttacaaataattctttggatcattgaaaaattattgaatccagacaatgacgatggaactaatggtagacaaaatgataagttgaggggatcagtttccttaatggctgcctcaatcaaaattgtgtctattattatctgcttgcgttcaattttagggtgactgttgactcctatgatcgtattgatattccatgttctttaaccgattgccatttgttattctttagatcaatgatctttttacggttgacaccaatcttaatcatgttttcgtttctaaccttaagtgaattcaaatctaaaaaagatttatgtggcacttccatacatcttttgtttagtttcccgacggcctcatgtaatttgttttctatttggttgggcagcggtggcttcattactgttgacattcaaatactttataactaaataaaattactgttgtaatcttttctttgtcaaggtttccaagtagggaagtaataagataatgaatatgtaaaccaacattccttggttatctaatttcatctctttatgatctcagatgttgcagttcacgtcaaatccataatttctatacccccagcggtttctaacttggtgacttcaatattatgattctcttcgtttgaatcatcatcaagaagttctattactagatcttcttgaacaggcatatagtttttctgatcatttgagttgcagcatgttttgttatccgctgcccttttatctgccgcgattgctgccatttctctagcattccttcttggtcctgttccaggtgtcgtaccacctagtcttcttcctttacctctttctaatgtctttccaataataatcgaccccatcggtttgctacccaatcttttcccggtgccgagaaagctgtcgtaaagtcccatttgttcaatggtccattgtcttcccgataattgatccagcttttcgtaaaactttcggtcatgaggaccatgtaaattatgggtaagctcatgaagcatggtacccataatagattctatcggtagaaatttatattcgtctaatgggtctctaagccgcaacatgatcttcatgcctttgttcacgttcatacctaaaagtgatcgattccgtggataaaactcaactaattgtcttactttgaacctttcctctttcatcagatacgatacgttatgagcgacccttttcaatatgtttaatgcatcgttttttcctggttttgtttgcaatactgcaatgcttcctacatgcggattcttttgtatcggaggaaccatctgtgcgttgtccgtatataggctgtcattaattttcaatagcgcaacttttttagttagttcatatccataggatattctactgttatcatccgcagtagtatccaatactaaaatccaatttttcctttggtctcttcgtttgatgtgtctccaaatggaggttcttttgaaatgtttaaatacgattcttaaaacaaaaatcgatagtccactatttcaactaaattttttaaaaatacatatcgtacaaaccacattcctttctaatttattctaaagtgtccacacaccctgagatttccaatcgattttaggatccaccaatacaactcaagcttacgtacagttccacagtgatttaattgacctgtgaaacaatatatttattggtaataaactaaattattgtcgttcatcaaaaacatgacagaaagcgcgtcgaatagcacgggatcaaagtacggaagctcagagtcgtccaacttgttgacgaagcctgcattgtatggactatatgatgctgatgtgctcaagagcgaggactcagagatctatgaagaagttaaaaaagcatcaagtggtaaagaattagaaaatggaatagtacaacgtgctaagaaaatccctagttctgtcaatgtggctttagcatgggttgtactatcgatagcaggcatcgcttatcatgaattatcaaagaacttacatgataatcatgaattgcataatgactttacttcccgcccgttattattgggtgccactattgcacaatcattaagttttgggtatttaccaccttggacattttacgccatcgaaggtatacttttcggaagtatcgttccatttgtaaactggatacttggaacctttgatcggcaaccaaccactatttctagtgttttaagatctacaaatgccatgttaggtgtttcttttgggattcgtagaattgaatggtcttccagtttacaagcaagtggtgcatggttcttactcaacattatcctttggttgttctttgacagctcatttactatgctagcatctggtttggctattggtttagtcacttgcgtgacctgctatcaagacattaccgatagcgcacagttgttatatttcattgatttctacttccttggtctactattcttcacaagactaggaaaatttttataccgtcaataaatatatatgtataagttcagcggcaattacctcatgtcacaatatttatacgaacatcttctttcctaaagtttataatactaatcctatacaagtaattgtccgttatttgcaaagcgttaaagtttccattatataaaagcgttacaacagttgatatctaatttatataaaccatttgtaattcaagtatggtaagatcaaataaaacggggcgacatagagaaaccatacgatgtgcatgagacttacgggaatgttgacatctgttccgagactttcctattgatgtgattctcgagtttaataatagaacaactactatttattgggtgaccttggtggtggtggaccacttgatatactgccttgtctatttagcctttgggcgtcgacattgctgggaccgtttgcactactggacattcttcttttgatgatactttctcttaatccgctaggatttgtcaaaggtaaattgttattagcaactggactcgactgcaaatcgtcagatttcacacctgccctacgtaaagcgtagtccccgctatcgaaatattttcgttcttgcaatttgtgttggaataagtctttcttactgggtagttttccatacattttgtatatttttaactcttgtggggaaagctttgacaaatcaacattttctggattagctacaggagcttttggatctacactttcagaatcatgtatatgtgggtgtctatgttcatgcccaaagactgggtgttcttgcttgtcagacattctgttttttcacagatataatttagagtgttttatctttgcttccctaatgtgtattgtggatcaagcttgaaataccagatattcaaatcacgagcaattttttgaagaggccagaattcctagtaatattgaagtcaggctgccaccttttatctaaataatcattctataaaattcctaattcaataaatatgattacaatggatgcaccagttcgcatgatattgaccctatctatctatattcatcattcacatttattctattcttccaaatgctatgtgaaaagtgaggtacatggggagaacgatagggcgggtaacatccacaatggattacaccaatgtttgcatgctaggagtcatatcaagtcattaattgatagcttatcagtgccgttaactgaggaattgataagctctaggcacactttatattcgcagggacgaatgtggaatgtagagttgttgcggtactgaatagccgtatgcgtcgtagaaattttaccattctattaattatcaatacgatgataaaaaagtggaaaagaatctttcaaaatcatgacgatggggagtacgtaaacgtggacgaatatttcgatgtataggtgcaacaaaatccttcgctgctaagtgaatgaatatcctgaattgattattgactaacagttgtgatccattcgtttaaaggatacccttaccagaagtgttcatagggtttttttcctagttcaaccgaaattatttcggcatttccagagattacttggaagagaggttagtttaggactctaacgaaataacaagaaaagagccgtaagttatcactgcttatacgaccaggaaagtggttgttagataaattatttaaactgctactgtactatagaggggataatagagaatactacgaatacaaggcagattctgtgttccagcagtaagaacgacattcgaaattatgagagtaggagctttaaccctttgggtgattaatctaatagtgctgtttaccaatacggctgaagctagggattactccaactacaaagtgtgcagattcaacgatgagtctcaattcagtgttataatctccaagttgaaagacatagcaatgataaaacaggagtacgaattcgatatatgggcaaaatcgaaatcgcatggatttatggatatccggatgcacgatgacattttggaacaattccctagttgcgatattataattgaagatttaaattccgtcatttctgaaacaaaatcggcagttgggggagaaacctccaacgacgccagaacccagagtttttttgatgctgaatctaaaaggccaaaagatatattctttgacgaatatcgtgatttggacacaatttacacatggttagatctcctacagttatccttccctgatcttgttacggtagagtggactggtcagaccttcgaaggcagagatttgaaggcccttcatatctcgacaaataacgtcgagaaaaatcctgataagaagacaattatcattaccggtggggtgcatgctcgtgaatgggttagtgtcagtacggtgtgttacactattttccagttactgacgagatatggtaaatcaaaaactgagaccaggtttttggatcatttggactttttaatcatacctgtattcaatcctgatggttatgtatacacctggacgcatgataggctctggaggaaaaatagacaacagacttattttccacggtgctttggcattgacatcgaccactcttttgattttcaatggactggctctaacgactttccatgttcagagagctacagtggtgaatcaccatttgaggctttagaagcggaatcatgggatgaatatgttaacaaagctaaatctgagtacaatatccacggatatttagatttccactcgtacgcccaagaagtattgtacccatatggttattcgtgtgatgctttgccgagagatttggagaaccttttggagttatcatatggcttatcaaaagctatcagacgcaaatcaggaaagggctatcatgttctttcatcctgcgaagaccgtggttctgatttgcaaccaggcttaggatcaggatcagcattggattatatgtaccatcatagagcttattgggcgttccagttgaagcttagagacactggtaatcacggattcctacttccacccaagtttatagttcctgtgggtgaagagatatatgctgctgttcagtacttctgtgaatttattcttaaccctgacctctaatatcacgaactccgttgactttgtttccttcaattcatgtggtaaagtaaaatgcaagtatatttagctcctacttaataatcaatctgatttattctgtttacgtacttcgagaagttggaaggggtctatagcccgtataaaggaaatcgcacatattaatacgcatgcgagatagaacagtattgaatacatgtcaacaggaattccaagttttatcactgccaagctaacatctacctttactttatcttgtaaaatgggataagaatctgctcttgtttctataaggatgactgctctggtctgtgtgcttaaagtgcctttaaatacggtgccatgaggtatgaattgatgacgaatcgatttaagggaaataggatcaattcctgtccaacaaattttgaccatatagttttcatttttctttagtcctgtcaattccacaaacgtcttagcctcaggttgaaggtgggtagtgatagtcctaaatgttgtattccgtgcattgatataaggcaacttcggtacatatgatgggcttaactctggaaaatcctttggaacatgaaactgatatgtttcagtattaccaagtgccagatgacataatgagaaaaacgaaatgatacgtataaggaaagtagccatcataggtccgagttagtttcagatctagttgcagttaactgagtgtgtgcagtggatttatttttggggacgggttttgctttattattacggacactctttagtatatatacactttaaacttcaaatgctttattgacattttttcagaattatttcatactatatcacaactttaaaactaaaggaagatcacctacaagtcggggtgacgagttctttggtggacttgtgtcatacgttctaagccagatcatcacagttctggaaaattacttaatatactatgagtgatgatgatgaattatatgaacagtttcaatatgagatggagcatggcacaccgcacccaaatgttgttgatccacgagaactagaacaacttttacaacaactggaagatgaacaagaacaagttttcttgcgcagaaatgtacgaccaaggaatgcgccagtacattggccggattttgttgtaagaagaccatatctgcgatttcttttaaggaatctattgatattggaccatatattgatggtcttgtttctcccattttctcttttcaccgttctgaagaccgttattaaccaggtgactttcagcgacaccgatgtcttcactgaagttgtcgattatgttcacaatcgtcaagttgtagatccaacatccagcatagtgtacctttacagaaacggtgccggcctattaggatgctttcacaactcagctgtctatcattctgcacctttttttaaataccttatgagaatctatgaaaatccaaacgttcttcggcaactctacactatctacatcaaatggtatacggtcacagtatatctcggatacggtatcttcgtgagttcttacctctcctttgtcaccttctttttcgtcgtatgtgtgacgcttctattcatcaagaagtttaagggagtggatgttatcatcgctaatatcctacaaacatgcaacttagtattttagtttagacattacatagaataataattttgcattagaaatggtgggaaaaatactacagaaattaaacagttgcctttatttgtggagttaacatgaacaccgacttgtccatgtccttggggaaagctcaacataagcaccacggtgaggagaaggtatcatgcttaatattatatcacgtgactgtatacggtcttgtcttgtcatttccgacaaattcctgattgggtaaaactttcccctgcaaaaatagcgacctttggagttgttaagataaaatgcgcgataataaagatagatcaagctcgaggtataatcgcacggtatggtaacggacaatgctcaacaaattgaaggaaataattaaacatatttgatcgggtttttggtactttgtgatgatcggaaattgacgtatataagtgcttgctgtttagcttcttctcagaaccgctttgaaggaactcattcggttacttctaacaagggtattctcagccacatcaaataaagttcttatagtatcccactttcattattagtacaacagccctgctcaaaattgataacaaacaatgaaggttgcaggatttatattgggtgctttgatacaattcagccttactgaaggacatgtagaacagaatgaaaatgccaatctaacagaaatgtggggcgaggactggcccttttctggaattcaaacctttgcacacttacctcaccacaagtgtttgatcgatatggaaaagaagtttgatataggggtcataggagttccgttcgatacagctgtgagctttagagggggtgctagattcgggccacaggccattcgtaaggcatcccaacgccaaacttcgatgcgcgggttcaatttccgtgcagacatcaatccatatcaagattgggcttctgtggtcgattgcggtgacgttccagtaacaccgatggataattgcttagcgttgaaaatgatgactgcggcatatgagaatcttttgagccatgaatcccagacaagcgacaataatttacctccaaggtttgtcactctgggcggtgaccatagtatcatcttgccagcgctacgtgctctaagaaaaacttacggtcgtcttgctgtcatccatttcgactctcacttagatacctgggcaccttctaagtacccatccttctggcacagtgatacttcggagtttactcacggttcaatgttatggatagctcataacgaaggtttactcactgaaaataacaatatccatgctgggttgagaaccagattaagcggatctagtttcgaagattacgatgatgatgacaaagtcggatttcaccgtatcgaagcagacgaaattatggacggcggtattaagtccattgttgaaaagatcaaatcaaaaattcctagtgatgtcccggtctatataagtgtcgatatcgacgttttagatccatctgcagcaccaggtacaggaactatggaagtcggaggatggatgactagagaattgatccgtattattcgtgaactagaagatctcaacctcgtcggtgcagatattgttgaagtatctccaccattcgatcctactgaaattacatcgttagctggtgctcaaattgcatacgaattgatcacaaacatggtgaagaaaggaccaatagatccagagctgattaagcataatcttgaattatcagataagttgactcaaggacaacaattgttaggtttttcaagcccaacggatgaactaaatgacaaaatccaaaaagaacaatttgttttgcaagcctgaacgataaataacaatgatacttaattaactacagctttccctctataatttaaacgaaattatcacggactttacctttggtttaaaagaagaccatttcattagattgtatataagatgccttccagtagtgacatttttcccttttctgaaattctcaactggtgctctcaatacttaaagtaaataatgaaaaatatcgaatatttagaagaacagagagaatcgatccagacatcaacaaaggcgatttcatctactgctattcaaaccttttcttcagtgaactatagcattccttcccttaatcgttgaaatatgttatttatacggcagctttcagttattcctaaagcgcctgcttttgctaaatttttccataccgcgggactggtccgccaaaagctgtcggaccctaatcacttagcaatactcttgcaaaagaacctcgctcaaagaaacagctctctgtacaatcccgaactagagaccatacgatgcacaatattcgataggcatggaaatatgcagaaaccgtccatcgatctacgaagagatgagctcatacacacacatggactcctaccccgagacttgcgaaaggttgaaaaatcgaggagaaatgacttggttcccagtgttcttgtgcgtgagaatagcattttggttagtatattgaacattagggctttggtaaaatcagacatgttaattcttttcgattcgatgggtataaaattggattcggtttctcaacagaatttcattgcggatttacaactgagattacaaaatagaagcggttttgaggtaccagatgttgtgaataaagatcctttgccttacgagtttagagcagtagagtccatttttatttcggctatatctaaccttaacgcagagctcaaggttcacctgaatgtttcaacgggtattttgcaagacttagaatatagtattactagagataagctacggtatcttttgattcaaaataagaaacttagcgtctttcacaaaaaatctttcttgatgagagaaatgattgaagaactattagagcaagatgatgtcttgtgtgaaatgtacttgactgagaaacaattagggaagcctagagaagagcatgatcatgcagaaattgaaatgcttttagaaacttattacaatcatgtcgatgaaattgttcaaactgtaggaaatacaatgtccaatatcaaaactacagaagaaataatcaatatcattcttgattcaaatagaaatcaattgatgttacttggattgcgtttcagtattggtttactctcgttagccggttctatttttattgcctcaatctacggtatgaacttagagaactttatagaggaaggtaacgttggattccccgtggtatcgacattgggggttattctaatggcatatctgtttgcattctccgtcaaacatttacacaagttggaaaaggttcagttaatgagtcatggaaaaagctctacgctaaaataaaactattcgaataagtgctcctaacgtattgtgtaaatactcaagttagggtagcattggattttccagctcttaaatgttttatgaatgttgtgtatatataatgtgacatataagcatctaatgcaattcgcattagaatacatactactcgactgcttctatctttgttccagcgaaaaacacctggcagaatatgatattaaggtataagcagtagtgaaacggattgaaactgtccgatattctagaatgtttcacgactgtatgttaatatgcagtaccaacctattgttaagtttaacgtatcttcattacccgggagaacgattgtatcacgtgatcaaggtcgtttttgtcctggctcttgaatggggtgcaaaaaatacaattgaagactggaaagaaatactattattacatttgagattgaatcattatagaaatttgataacgggctataaactggttctggttgacaacatccacgtaagcgacgaaacttataagctagtataaaggatcttttattcaagatgtcaaagtcaagttttgagaattatttctcgtttcaaatttttttcatcttcttgagagagtcgttagagatcatcataatcgtttccatcttgttgacaatcgtcaaacaagccttattctcgcatgataccaccgctgaatccgatacagagtcttcaaaaaatgctgccccggttaccattcaagaggaagaagcttcagatttattattgagagttaatgactccgattctccaaatctaggtctagaagttgataaccagcagttatataaaaaactaaaacttcaaatcatttctggaggtttgttaggccttttggcatgtatgtttattggtggtggatttattgtggcattttattatgttggcacggatttgtggtctatgagtgaacattattatgaaggtgttttaagcgttattgcgtctgtcatcatttcagttatgggattgttcttcttaagaatgggtaaacttagagagaagttcagagttaaattggcatccatcatttactcagacaaattacttccgatggaaaatggcgaaagcaaagctaaaagtttcagcgagaaatactcattattcatcctaccatttgttacttctttgagagaagggctagaggctgtcgtcttcattggtggtatcggtatcgatagtccattaacctctattccactatcgatgctttctgctacggcgatctcggcaattttcggtgtattcttcttcaaatactcaaagtcgttttcattgcaaatttgccttgtggtaacaacatgtttcctatatcttattgccggcggattattctccaagggtgtatggcagtttgaacttcagaagtatgttgatgcttgtaacggtcaagatatgagcgaagttggaaacggtccaggttcttatgatatctcgcgttcggtatggcatgttaactgttgtaacggtgaaagggatggattttggatgattttgaccgccatttttggatggactaactcagctacctatggttcagttagcagttatattatgtactggttaattgttatcgctgttataaagctaatgatgctcgaagagaaacatggatatattccatttttgcctgtcagtctacaaagaaggagaatgaacaaaagattatctattattgaaaagtctcttgcactcaaatctcaatcatccacgagtggctggaactcatcttccactaccaaaaacttgcctgatattccgagagcttcatcggatactcacaatagctctagcctcctgttagattctaattcgcctgctcaaggttatcagtgatgaaatagttagctattattcttcaaagttgcatgtaaacgaatcattttcttgcgtacgcagttgctccatttggaaaagttacttaagagaaatactatatactatttagaaattgctgttgtaatataacacattacgttggattataacaagtattgactgtttttaaaggtgacggcatgtcaatgtgggctgctgcatgattacttacatatttctttttggcatattctgtcgtttgtttgaatacaatgttcccttttgtacttaaattcgaaaagtccttcaattcggccaaaaaaaaatgagcaaaaaataaagatatgatcaccaaaatctggggtagcgggacagtatatattacaataaacaccgaaagcggttcacttgtttctaacttcagcttcactcagtgaaaacccgatgtacatgccgctgttatacaaaatcaaagatttcacttcataactataatatctgtgcacacagcaggtttaatgtctcactcagtgtgtattgcctgtgactttgacaaagggtggatttctttgtttctgggatcaatatatattctaccacaacatgggaatctaacactctaagtaacatttcacccagttgagattcttacctagtttgaactcagcatcaaattgcagtaacgggagcctatcacctcttcgtaaacgctttttttccggtcattattcgtggatgtatcatagacgtttatatcaaaatgatgacagaatttgcaacgtaaaacgattcctcttcagtatgggatatttaattcaatcatcaattcatttgttattataaggctattgtacaattgggatctttttttgattttgtgtatcattcaccaagtttgttggtatttgttcgtggacgctgacaccttgtacaggcaatcctaatatagtcatttggttatggtaaacgttacagattacgaaactcctaataagagacaaaaggataattcaggattgaaaaagaatctgattctaaatgccttcttgatgagctctcctggtaacgaagtgattaactcgtggagagagtaaggtaatcagagctctcattctgctgaagatccacagtattggatgaaattggcaaaattgctggaagatgggggggttactaagttttctttgccgatgttttaggaccctatgatgtttataatggaccaggaaactttaggcctgtcgccaaagctggctctcgatggccattaccagatctaagttattatattctattaaaggtcgcagtggccaggacgttggcatttggtattactatatcgacaattagcgaacaaccgtatcatttggcaagcagtttcggtactttggacttaattacaaagggccgcatcggatagaatattgtgacatcttctcttgacagcgcctcaaagaatcttttgaacggtcagaactttccgggcaagacttaaaggtatgaaagagctgatgaatattaatgttatttacaaattgttttaagctccgggagagatggtgctgtaaaggctgataaggaaagaggcatatatacagaccccgatgggttgagaaatataagtcatcaaggtaaaaatttcattgttccgggtcctggtgttacacagccaagccagtaaaaactaccagctcttatacaggccagattattcgccgaagggtaaagaattagcggcaagcaacgtagaaattgtctttctttcaaatccttcaaaagaatccctgaggaaagctatttgtttcaacgaacagtacgcagaacatacatttaacagagatccttcgaagattaaattcattgttcaaataattatcgttattggagacactatcaaggatgctgaagaacaagaagctcgtattagactattggcagaagatgaagcagccagagtgatgttttcgggctggggcggtgttggtcttggcgcttatcctgatgataaaccgttggacgatttagataatgcttctgtagtgtctttgatccaggtctggaaggaagcttatccatataataaaaggtggacaacaaatgattgttgttccctggcgttgtaggagcatttctaaggcgccaattattgaactaatgctaaataagaagctgaagctgagagaataccaaacatgatgaatatccagtccaacaatgatgttatcaattttataacgattgtcggatctggcgcagtcttcttggtaccataaaaggcatcgcagacaaaatagacaaatatgtttcttattcagatgttgctggatttaattttgcttacacatcagcaacaagagctatgaacaaatatctgctaagtttataccagaattgagaatgcgtggtttatcacttggttgtgaagcatagaaggaactaattcaacagcaaccattcttcagatatcagctgtttggaaataataatctgtaactcgcatccggcaaatgatttaagatggagtagtgatggatcaaaagaagtcttcgaaaaaatattgccaaaagcacttgaaaggctgactgtaaataattagatatctttaggtcatcatcattcaatcacttggttttattgacttgtttatggtacgttctattacatccactacgagttacactgaaaggaacatgtcaagctcggtggttgtaatttgcataatgatgaagtacccaatagctagcttttctaactgttcgtccgcgacctaccccatgtaatgtaagcagcattgggaaggagttgaaaagacagataatttctagacaaataacttttagaaaactaggttgtttatatttagttgaatattaatatttccaatccagcgtcctaatgaattaagggatctttaaccagatatgctgaacggggggaacgaattgaaattgcctaagaattcagaatcaatttttagatttgaatatatcgttcttgacaccattgaaaattttaatgagtgagtgtctgccgtcccacaatgggtagaggccaataaaaatgagagccaaataaacccagataatagacacaaccgtccatccagcaaagaaagtttttgaaaagatgtaatctctatacaatggtagaggccataccacccatgttatcaataatacgaatactgaagcacctgcagcaattttagtgtaaatattgataattctcacttcttccgcggtgaaaggtgtattcgctgggtttgaagacacttcagtctcgtagaaagcagaatcttctttcaatatttcaactgcattttcggtttttgtttccagttcaacgctaggcttaatacttttactactcttttcttcaattgatggagtagcttctttgaatctattattatcatcaaatgaatcttcttcttcttcttcttcctcgacaatgagtttagccttcttgaaatcagaccagtcaaatttgtaatttttatcaagtaaactaattggaacggttaaaacacctggcaagaataacgcagtaagtccaccatacatacagggtagttgtgagcctgtactggtaattgtgacctcgccataaaatttgtaggcagttcccaaccaaactgcaatgcctgccaagaatccgatcacaggggaaattatggctgcaagtggtgtttgtctatcccagagaatagtcaataccaatggtatgacacctggacaaataatcatagagtagaaataacccatccatgtcatatctactccgacataatgcaacatgaccgtaaagccagctgcgaacaaaccgaagaaaatgaccccaatatgagatactgtgattaattgtgaattgttagcattgggtttgaaataattcctgtaaatgtcaaatgagatgattgaactaacggcaatcatttgagcactaacagtggatgtcacagcaagataaatagctaacaaaagtccacccaaagaactttttccgagcacagccattagagtgtaaggcaaaccgaatccattattgatctcgtacgatgtcatagctcttggataggttgggaaaaaagattctccttctaaaacaatattagacagacctataatggtacctaatggccatacaattgcagggatcaaagctgcggcaattaaatatccgggcactgaagccttgacatttgcactgaaggctttctgccaaaaactggaatccataactgtcaatccaaaatcaccaacacagtggatgatgccaaagaaaatggccccttgagacttaccggttaggaatgaaccctgatagttaccttcgatgtatctgtcaccttcgtgttgtattaccttgtcgtataagccgctaataccgccgatcttgtcactggaaataaccgcagtattaaagtagactaggatgatcaaagcaattaatgagtgcatgtagtctgttaaaaatgtagccttaagccctccaacgacagtatagcacatgacaccgaatggaatcaacatagttgaagcgacaatatgtaagtttccagaaataatcgaaatagcagcagcagaccccaaaatcatggatgaagatgacagtaaattgttgacaagacacataaacatgtagagaatatgtgcacttttaccataacgtaattctacaatttctaaacaagtatgcccatttggaattttcttcttcgcttgaatccctaacaatgccatcagacaaatttgaacagatagccccgcaaagtaccaaaaactactcataaccccgtaagagtaaaccattgtgacaacccataagatttcagttgcccaataccaagaactgaaaacaacagaacctgttaaaccaatacccacatttctgttagcaaccatgaagttctccgtagattgtgaatcttcatgtagatattttcccatcaatttggtagcaacaatgatacccaccgcaaacaaagcgccgacaccaatcaagacaccataccctgatgcttttgtcaataaacttatattgacttcatctgctgaactcatttggaagaatttctttggtttcttagtatcataataaaagagagagttgcaattcaacaaaagcctcttgagtgttgacgcataattgttagatgtgaagcttatataacttcccgataatactagcttcttcacaagaaataaagcgagtgactttgatcttcagttaaatctactaagtgggaatcgaactacccatgccaccaccacagtgactctgctaaattcatctttattctattggtgtaatgagcttcatagataatcagcgttattaccacacgtcggcgcagaaaaagctttactacccattccggtttgccaatacatttatttcttatggtgactttgatggaattaaaagagtgagagctaaagaagacttacaatataatcattgaaaaacaactcatataatagccgtactgtaaatgacattacctagacaagtccggattccgtgagatgaaaccggtaccaagttaaggttatagcttggtgagtggggctcgaacgtgttcccggattttttcttttgatgagtttgtactatgcttaccaaccttattcattctatgattgtctttggcatgagccacaattatcagcaaaatccattgaagagccaaataaggcacagtaacaaaaaacacttcgtattaacagctatcagctgccatcaataatgaaagtaaacatatcttacgtgtctgcctaatcacgcggtaggtaaaggcagtcgaaatgatattttcatgtagaaactattacatcagtacggaataatattaccggaagcacaacaattctcaatagaatcaggtacatgatggagaagtcaatcaatgtggacggcagactcaccccattcatcaaaatgttcttcttagcggaaaccaaacgtagcttgcgaataccggaattcaacatgggggcagagtataacatttcaatttggattttcagcaatttcttatactcaactgagcttgaatgtgtttgaatggagatttgtggtaatataatatcttgatagtattcactggatacctagagaacttagtggaaaggtaataagaaagttcgtgacaatacttcctgaagtcttttttttattgctcctaactgagttgtttttttttcaacttgtaaatgaacaattggcctctgagagacagcggttagtgttcgaatcatatcggctttcaaactgataatgtattcgttaagatttccctccttacacttcttgtaagttgaaaattgtcacatagctacaaagaagtgggtaaatcaatataagagtcaccgtgtctttgaatcagcggatcagaatgtagaatgtatttgaattgatttatcgctcaataataacaccgccttagttctcttgtaccaatgagagccattcttagtacggcagaaacagaccttatatttagttacctttaccattcattgcatgcatttagtgttcggtagtcttttttttgacgttttcagtctttgtaactttcttcttaccaaacatacagcgaatggataataaccatcgcgttgctcctttaattttgcttttaggagtttgaaagtttaaatcagagagggtgaagcatctttatatcaaccgtttgatgttctccggtgtctgatcacaactaggctccgagctatgaaatttaagatgtagataacgcaaaatttcaagtaaagatttcttgcttgtgggtatccgaatttgctcaagttggattggacgatgatgagatttggtagcaggcgctttttttagagtgttagtagtatacatgtcaatagattctatactggcttagagtttgataatgcaattattggatggttgaactgatgctctgtatgcgaacttcagctaattaagtgtattatttaagatgttctacttggcttccgcctgacggataatttaatatagagccacaatagataggttgtcaaatccgaataggaattgaatgaagatgccatttacttatatacttgttacatctgatgttcaaatgctgggtgccgtagcgttgatgttgatcatagtgacttcagaattccttctgtatcgtttccataaagaggcgggctggggataagtacaatgccgtggaacaatacgtcattgttaaacattaaatcgatcctatatcgtctctccattacaactgttgacgaaaacgtaggagtttacaggatattcatttaaaagtttttataagacttgaccataatgaataaaaagctgagaaaatctaagtgatttctgctatggttatcattcctcggaagcattaccggaacattgagtaacatctttgttgtcaatacagtatccataaacgacactattcgtgttaaaaaacagttttccacgtgcagaagttaccgcacctaattgattatggccttgtccaccgccaggattaggattatcagtggctatccagcagctcttctaggcagttgaaccatgccaacagtcgtaaacggacggatcataatcttcctcagcgatcctctatcatgggcaccaattcttaacagatctttgtctgcatcaccccatgcccaaggtagttgtatctcccgtgtaagccctcctgattagtgtaatttaaagttgattctaaacagtcagggttttactctcagtggtattattgtctattaagtctggtttcagtattcaaaggtacggcagtattagactccagagggctatcaaagtatggaatatgaaccgtgtcagtgacagtgtcgtatgcatctacgatcaaaaggtatcatacccatcctaaagtctgttgaaggccaaacaccaatcgccaatagtaaaaactcacgcgagcagctctgctatctttcaccttgatatatgtggaatctcctgctgaaagaactgaattcttcacgttttgcgtctgatgaaatccaaccgttttaggttttcctgtagccgtttgaaagatagtaccaacggtaccagcaagcgtagctggcaagggctcctgctgatatcaagaacccagcaacaactgaacttgcaatccagttccaatgatcatgcttgactagcacataattagacacgccaccggctttctcagcaatgttaacgtcattcgaatggcctgcttgtctctgagcctccctatataaatgataacaactgatcaatccaaagaagaaaacaaatagaatgaggaattgaatgagaatggttttccatgacttcgtcgaaggagcttcacgaactaggttttcagagtcatcttgaatcatggtcagtttgcaggaatcacgcaacctatttgctggtaagaaataatacgtatctcatagttctataagcacactttcataatgaatgtcgtaggaaaccttttgtctcgttgattttaactttctcatgatatttttgtagtacatttcccaacttggaagatgtaaaataaatatgtttaattgagagcatttttttagtttttgagtaggaaatgaagattagagatggaaaagtgaaaggaaggaaaagatggagggaagaaagagaggacaaaggcaaggtgtagggaggaataattgggtgtaagcagtagtataatagtagtatagcggcagtatacatcgaataggaagttcgtagttcatagttcaagccatgtacaagggatatttgttactagagtgtttgcggtggtcacgtgtatggagaagcgtattctattcacagggggagaggtcctctatgtgagggatgatggacagagagtatgaaaatgaaaaatacttcctctgtttatcacgtgaataagttcaggggatgattcacgagagattgagcatttactcctggtgaaaaatgaaaatgggatggttgaagtagtcacgtgtattcaggaaaagggcaaccatttacaaggatccccttgtggtagcaggaatagtgcaatgaaaaatgaaaaaaatgaaacagatttgaaggaaaaggggtaacccggacaaaaacaggattgaagtatggattgagaatggatgggatgggacaggagagaacgactgaggttcgttccgtatgaaacgatgtaggaaggtgggtgaaaaggagttgcgtgggtagaaaggagtgataagaggcacgtgatgtacagtaaagcagggtaagtattagggtcaagaagtgaagtaattttaaatgaagtttggtggcaagagaagcagaaatgggagatgtggaatgggtattgtttgtgcgggtaactgtagtatgtcagacaggatcattgaaggaacatggagggagaggtgtagtttaagtgcgggtaagtagtaattgtgaaaaagatacaatctgatattcagagggagagagagggaaagaaaggtagaatgagaagggatgaaaaatgaaagtgaagagaagcaggtgaagagaagcaggtgatgggaagcgggagatgggaagcgggagatgggaagcacgtgatttataataaagcagggtaactaaggaagtgatgaagtgaagtaatttgaaatgaagtttcatggcaagaggagcaaaagttggaagaagttgaaaatgggtgataattgtgcgggtaacgtgtgtatcctatgcaaggaccaggcccagcaggaccaagcattggccatggcaagaaggtggattgacaaagaaaatgtgatggaagtgcgggtaaggggaaatggtgaaaaacagtcaagaatactgccaaaaaaagtataaattgaggaatgagaatggatgagagtgaaaggagaaagcgaaagaggagaagaggaaaaagaaattaaagtaaaaaacaaagaagcaaaattaccgaaagaggaaatccgtttcgagtgattagaaaagagaaaatgagaaaatgagaaaatgagaaaaagaaaattaccagaagaggaaatccgtctagagtgattaaaaaagagaaaatgagaaaatgagaaaatgaaaaaatgaaaaaatgaaaaaaatgaaaaaaatgaaaaaaaattgaaaaaaataaaagtaaaattacccagaaagggaggagcggggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacatatacttttcatgtggtatcttgcccaacttaatgtaaatactccattttgtataggtttagatgaataagtagattctttaattttctttatcagcataaaatcagtgtcccatatcttatatgcctcttctgactcaaaatctatatcatcttctgattttataaaatactcaaaatttacccatttttgtgcgaatttgccccataaactgttcataataattttgataacattttccagcacactgcgcggaagatgcataacaaaacgacagagactgagtaaagataagagaacatgtagcagaatacatagcagacagacgcctcgactaacgtcgcaagtatgggcgatgatcgcaagacagtcgacaaaacaaggaaaagaacataaagtaccaacgcagagagtattactataccatcaatcatgctggcatgtttgcacggagaatcagtgacaagggaaaaacatgtatttcatagacaatagactcaagaaggaaggataaaacagaatagataaagaaaaaaacgatcgaaagagaaggagaagagaaacgaactcaaagaacaaaggaaattagaaattagcaacaagaaaaggaaaatagagaagagcgaggagagcgagaggagagagaaggagaggggaaacaagacaattgaagcagaaaaagcagcagctggaagaacaacgaggaagtattaagacaaaacaagagaggaagggaatggagaaatgtgagctgagtaaaagaaaaagtaaaaagaaatacggttagcgggtatacgagcaccgaagtacggatgaacgaggagggcagggatgggagggagaagatagtatacggggtcagagagaagagaagtaacatacaggagtgagggaagtggaaatggttagaatttaaagaagagagtggagcgataggaagaggaagtgaaaaaagaaaaagaaaagagggagggggaggaagaaaaaaaagagatgaaagcagggaaggaataaaaaaaaaaaaaagaaaagaaaagaatggaagagaggagagggaagaggagaagaaggagaaagagaagaacaagaaagagaaagaagaggggcgaagagatcgtcggaagtgagaacggcaccgacgaagggaaacggggcgtggggagacgacggcggggaaaagtatggagagaagaacgaagaacgatgaagaataaaataaaaggaagaaagatcatcttaaaagaatgagacgagatgagggaaaagaaaaaagaaaataaggagagaaggaaacgaggtgcaacagacaggcaaaaaaaaacaacccgcaagaggaggcggcccccagaagacccgggccaggagtcagggcagaaaaataaaaacacaacgctcgaaggggatgggtagctgaaggagccgaagaaggaggagcggcaggctgggagtcctcccccaatatataatataaaattatatataatataattttataaattaatataatataatataataataaccccgcggataccttattaaaaggtatccgcggggtattagaatatattattatttccctatagaatcgataaataatatgccccccgactcgttgccggagtaccccggcaacaagaccgcggggataagatttaataagaattatttcttatattatataaaccccggacgccatcgtccgaccctagggtcggacgaggcgtccggggaaattatttatattttattatgaatataataaaaataaattctatattaatactagtaggacccaatatttatatgtaccctataaatgtgacatcatatgaccgaagaaaattatatatttatattatatatcttactatacagtattaatgattttatatatttttatatagaatatatataatttgtatggatcccgcgattactcataaaatgagtaatcgcgggaaatacttatctcatatctatataatatatatatatatattaatatcaaattacccggacgagccgtccggggttggtattattaaatataattattattattacaataatataatcccgcggattattcttctaataatccgcgggattatatttatatataattattagtatttataattattattattattacaatatttaccccgcggactctcacccaacattcgtggggtgaagagccgcgggaaataatatatataaatatttacgaataattccgcgattactcataaaatgagtaatcgcggatattatatatattcatattattctatatatatatatatataagtaattaattaatattataatatttatattattattaatatataagatatatattatttttttttaataatatatataataaaatatatttattataaatattatagtatattttacatatattattttataatatatttataataaatatttataatataaataacatgcaattagtattagcagctaaatatattggagcaggtatctcaacaattggattattaggagcaggtattggtattgctatcgtattctcagccttaattcaaggagtatcaagaaacccatcattaaaagatacattattcccattcgcaattttaggataaagagtgagtcctatttttcttatttatcccataatcttattaagattatgggatataattagaatataaaattgggtgaattgcaagaaactcctagtatttaataattatattaaatatggacaatttgcagcgaagtttataacaacctatattatattattatataataaccccacgcggctcgtccaaccctacggttagacgatgccgcgtggggagttataaaaacgttcaacgactagataatgagttaggttaacaataatttatccacgagcgcccaatatcaaatagattatatttgataatgacatagtctgaacaatatagaaatatattgagctaatatattaaataaatattaggccaacatatacagttgctttatcagaagctacaggattattctgtttaatgatttcattcttattattatacgctgtataataataatataatgaaatatctataataaaaatattctttttcatctttgggcaatgcctcccgggatatatatataatataatatatatatatattatatatctattattattaccaattgcgtactcctctcttgtagtagtctgcgagtagatatattattatactataaatttattatcaagaattactcttccctgcaaatgtgacatcacccaaccctagggttgggtgatgtcgcgcaggattataatataaacaaaccccgcggctacctccagtattgaaagtagccgcggggaatattattaatatataaattatctactagtgattctacaatttctaaaaatattaaattagaattatgtaataaattaaatgaagaattaaatactaattcttcaaaccatactcccccccgcgcggcatcgccctaccgtagggtagggcgagccgcgcggggaatatgatgatattatttctaaaattaatattgaatatattgtaggatttatcgaagctgaaggtcatttagctatttctaaaaatataaacaataactataaaataagtttagaagtatctcaacatataaattcacccgcggctcctcccttcggggggagaccgcggggaagatttaatgaaggctattcaagatactattttaaattgaactcctgataatagtttattatatgatttacctaaatctactaataaaatttataaaccccgcggctcctcccctggtaatccctttaaaggggaggagtccgcggggaagatagtaataaatatagattttaaatttctagtactgatagattatattatcaagtatttccaactatgttaaatagtggattatatactagaaaatatattgattttgtaatgtgattttctagtattatcattataaaacatggtttacataaaacattagagggtcaattattattagccccccgcggctcacccaaccctagggttgggtgatgccgcggggggaagataaatttagatctttccccgcggactccccccgaagggaggagccgcggggtgtattaattctaatagatattttcaaaagaatgaattagtaccattagattttattttagaagtattatctatgaaaccaatttatgatccatctaaacctcatgaatataattatagaagcccctcgcggctcatccaaccgtacggttggatgatgccgcgagggggaagatacagaaagtattctaagtaattacctaccataggtagaataatgattataaataaacactcaatattctttttttttatatatattaaaaactatattaaaaaatatatacaataatatgtattaatgaccccgcgaccatagcatggtcgcggggaacaataatcaatattcttttcatttttattatatatattgtatatgtatataatatatacattatattccccgcggcacctacactggtgtataccgggtaggagaccgcgggggaaaaaagatattatattataatattgataatcataataatctcataaatttataccagccctcatatgttatatgagggctggtatatataaataattatatattctatttttatataataattattataaaatatattaaaaaatatatacaataatatatattaatgaccccgcaaccatgctatggtcgcggggataattataaatattcatctaaaaatataatatatataatgtaatttataaaataatataaataaaataataataaaaataaatttattattataatatatacaatatatactatattataaatatataaatcctctttaagggcaatgtattaatattatggacttctataatatgggagttggtaataatattattttaataaatatatagtaatacttactatattacatctaatatatatagttaataataaaaactattaatatagataatatcgccaaatacccttagaataggggtatttggcgataaataaataataaaaataatattatatataaaattatatataatattttatttatattacatctaaaaatataatatatatagtaaattataagaatcccagggctctcatcctacgtacgtaggatgagagccctggggtaactatttatatatatatagaatatagatatataatatctaatttaccaatatcctttataagggtattgggggaattaatattctcctaatggtgtcccaattggattttcgaggcaattggaactatattaattatcatatttataataaatattatatatatattatattataaaaaaaatataattaatatataccccgcggactacacctcccttcgggggggggtatagtccgcggggattaataattctaataattataatttcttatacgatattttaagagataaaaactatataattataatattccccgcggctcctcaccctacgaatgtagggtgagaaaccgcggggggaaaaataaaaatataataatatattatatatatataaatatataatatatataatatatatatttcgtaaataattcaatgaattattaaagccacctgatactaatagtatcaggtggcgtgggtaatatataatactatatattagtattatattatatacgaatgatgtaggatttgaacctacgaagcctaaaagacttataatatctcaagtattacaccttaaaccactcagtcaaccatccatttaaatatatatgaaactaataggaattgaacctatattggtaccttatcaaaatactattctaaccgattgaattatagtttctatgctccccgcgacctcctcaccggtatataccggtgaggaggtcgcggggattatatataatggagttaatgagacttgaactcatattaaatgcatgcaaagcattcgttctaccaaatttaactataacccctacatattatacaataattaagtctttaataggaattgaacctatatcatctcattaacagtgagaagctttaaccattaagctataaaaactatatatttgaagggaataggaatcgaacctatgaagaacacagtcattgagtttacagctcaactccaattaccaacattggagatccctcctatataaatatatatataatatatatatattaaccccgcggatatatcccgatattatcgggatatatccgcggggactataaatagtttttcctaatttacttataatttcccattatactataatatatatactatatattataagccccgcggtatcacccaaccatccggtaagatgataccgcgggggaaaaaatatataattaccccttctctaaatattctataagaatgagaaatatatttaattatattatatatataatatatattaaccctgcgcgacatcgcccaacctttcggttgggtgtgtcgcatttgcaggtaaattatattatataattatattataaatatttataactaattatccctttttctaaaatattattatgtatatagtgggaatatatatattattattatattatatattacatatatatatataatatattatattccccgcggcacctataccggtgtataccggtgtataccgggtaggagaccgcgggggggggggaaactatttataatttcccgcggctctcattctactttagtaggatgatgagtccgcggggttattatttaataaattaccgcaaataatacattgtattatttgcggataatcttatatattattatccactttcgtaacgtaatttttataaagaattgcaagaaatatattatattcttattataatattatatttttaatacttataatgggacttgaacctatatacttcgcttatgagacgaatgttttaaccaattaaactatacaagttattatatatttatataatagtataaaattacctaatatttattaagtaatttcccgcggtcacctcccttcggggggtgccgcgggtagatattaatttatataagccccaaatgcatcatccctatgaggatgtcgcatttggggcaaagggtgaatactgagaattgaactcagatttaacgcgccacaagcattctttctacctttgaaatatattcacctataattatatataaaaatatagaaaaatgaacggaaaatatgagagtcgaactcataagaacatagttcaattatgtagcaaataatctaccttaccaatagtgaattttcctattacgaatctaatcagacttgcactgacatcaaccatcgtgacaagatgggactttactattaagctacagatccattatataattttactgtgtatccttaaaaaaaaattaagtacaggattatcaaaattaatataacccgccaatttatataataaattggcgggttatatatctatatatatttttatatataatatttaataatatatatttaataaataatattaataataataatatattattaatataatataatatattatatatttcccccaattgcggactcatccccgagaatctcagggggatgagccgcggggttaatatttatcccacataattaagtataattatatatgtatttataattataataatttatatatattataggtagcgagacttgaactcgcattcaatgtttggaagacattcagtttaccaattaacttatacctatattatttttataatataatactctctctatgactcgaacatagaatcttaatattagaagtattaggctttaaccattaagctaagagagctaataattatattgatcccgcgagtattatatttatataatactcgtccccccaaatgaggcatataggatgatgccacatttggggggggaagggttaatatattttatatatttttatatattttatatataatatataagaatagttggaatcgaaccaaacatgggatgcttaaaaggcaactgttttaccattaaacaatattctctcctccagggttatatcttcttataaataaggagacgtaactatattattatataaaattccccggacgcctcgtccgaccctcataaagggtcggacaatggcgtccgggatatatattgaaccggtttgattcgaacaaacaaattccaaactcaaattttggtgacttacctattagtctacgattcatatatatatatatattactacttaaaggatttgaaccttcatatcttgcgataacacatcttaagagtgtcgtgtctaccatttccaccaaagtagcttatatgcctttaatgagaatcgaactacatgtacataaatcttcaatttattgctttaccactaagctataaaggctataatatttacttataactatttttctactacagacagggtgagatgcgaaattatttttatatttttccccccgcggtctctcaccctacaaatatagggtgatgagccgcggggtaattattatattaaataataaatataatatttattattaataataatataatttaattattattattattattattattattattccgcgaattacccataaaatgggtaattcgcgggaggtataaatatttataattataatatatattattagttatataatagccccgcggctcacccaaccatacggttgggtgatgccgcggggaggatattaccaattattcctccctatcgcacacacatggtgcgtagggaggggaacataacatgtaattggaacatataattactatataactatataattaccattaatattattattataatattaataaaccccgcggacttatcctctgataattccaggggataagtccgcgggaaaagtattcaattgtctatatggagaatcaaaattataaataatattaatataatttaataaattaatataatatattataatctaataacccccacgcgggtccaaccatagggttggatgacccgcgtgggaaatataatattgtatcccgcggattatcattcttatgataatccgcggaattatatattaattagatcttatttttattaatattatatacaattattataataattaataatataatactaaccccgcgggaaatataaatacataatacataatatagaatatataataaaatatatataattactttatgtccccccccacgcggcatagtataaccaatgccgcgtggggttattaaataaatataatttgatcttatatagatgatagtttaattagtaattaaattttataaatttaatcctattattagattttagtataaaataaactataattatctctttaaaactacttcgtatttatatgcattcaatacttattatttattaatttagctttcctacaatgattaatatatattatatatatataatatatatatatataaaaatataaactaatattaattataattaatcaataggtacaccatagattaattcattttgatccttgcgtactaaaaatgagatttaaattgataatattccctatagaagatagaaaccatactgattcacatcgtatttaacccaactcacgttaccttttaattgacgaacagtcaaacccttcctagcacttacaaccaggaggataggtagagtcgacatcgaggtggcaaacataacttacaatatctactctttcgttatattaccctgttcaattttgttttataattatttttaattaattatttcaatatattactatattgttcagactatgtcattattaaataatatataatattatctaatattgggcactcgtggataaattattgttaacctaactcattatctagtcgttgaacgttcttataaaatatttattataataataataaatctagccccggagggcatcgtccgaccgtatggtcggacgagccgtccggggaggttattataagcttcgctgcaaattgtccatattattaataaataataatattaggagtttcttgcaattcacccaatttactccccgccttttactaaagtaaaaggcgaggataattatatatatatatatttttatatatttattatatatatatataatgggacaaatattttatccctagcgtaacttttattcgttatcaataaccattacaatcagtgttatttgttcattatgccatacttacgtacttgtttcacttgtaagtgttacaattgttgcacagttataccattatattaatttaatatagttttatattattgttttcatgacaattttactgtacataattttttctattatttaccttatttatattataaataaaataatataaatatggatatttataattattatatataatttataattttactaaaataatattataaaatatatatggacttattcagatacttttgctgaaaatgacgccccatcaaaactaccaattagagattgtttctttaattatatatatatattataaaaaagtataatatatatatataataatatttaagaatattatatctattaaatatattatataaagataagaattattataaatatatatataaatatatatattatgatatttagataagtatttcatttgaatataatctattacttaatatactgaacaaaatatataataattcgatctatctaattacagtaaagctgcaaagggtcttttcgtcttactacaggtacacagcatcttcactgcgatttcaatttcacttagcttaaaggggagacagttgttgtatcattacgtcattcatgcaggaccacaattattggcctaggaatttcgctaccttagaaccctcataataaggctgctatttacttaaatttaattatatatatcataataataatataatttatgaattaagcatggagcagagttcacaccttatactataacttaacgtttttgcaaagtgcggtgtttttagtaaacagttggacaaccttgtttttattactcttttttgactaacgttagagctatttttgccgagttccttccctttaattatctaattcaccttcatattctctactaacataccagagtcggtatacattacggtatcttatataccccgcccaactcttataaagagttgggcgggaaaacatactatttcttgatttttattagtttatatatatataataaaaatatgtatatttattagaattatcctatcgtattatatatttatattcatatattacttaagggccgtacttttattgttaaaccttatgctttaggtgaaaaggattatacctttttttcgttactcatgtcagcattctctatttaattaatttatatatatttataattaaaatatatatattattcattaaatgttccactaccatattattatattaaatattatataataatatatagatattcagttagataattataaattaagatccgttatattatttatttacataattattaaaaaaaagtaataattatggttttaaatattattattatatatagatcagtgcattgttacatgttcattaaaaaatggttattgtcaaacccattaactgattgtattataatatttaaatatttatttcacttattatctaatttagaactttatatcttattcagggctgtttccctttagactattcaccttatcgcgtatagtctgactccttatattttattaataaacatttcgagattaaatacctttgataaaataacaattattccccaaataatatttatagctgtaccattctttattattttattaaataataatattaaaaattataagggctatactaacatatatttcgtggaaaaccagctatttgcgaaccagatttgtctttcaccgcttaacacaactcatcagatgatattgcaacatcaacctgttcgaccgtttccgtctggtcatattaagatcgtccgctttcgggtcaattaatattaactaattatttatatataaaaatatatataaattatatatacaatgtttatattcaaattatttataataatttaattattattttgctaatactaattacttgctgacccattatacaaaaggtacgttattaatatattaatatatatttataactgcttataaaataaccaattacttattttcccttacggtacttaatttgcttattaataatatttagtcttagaactagtttgtcctatattcttacataatatgtttacataatacttaacttattatatataataatatatatataatttgactatattattttctctcaccaatactcataatatctctgttgatttatattctttaagttacttagatgtttcagttcacttaatttatattttattaggtttaccttaggttttaaaaatatatatataaaatatatattttattagtaacctattattattaatagcttttataatccttgattatctctttaaatctatataagaaatatttcaaattatatttatttaattacttatattatttatattatatattatatatatatatttaaattaaccccgcggacttatcccaataaggtgtataccggggataagtccgcgggagaagagattatattattatttatatcccctgcaaatatatactatattttcctacctatcacactcatatggtacgcagatattgaaagaataatattcatttctcccccctttacacgtaaaatctactatataattattatgccaaccccgcggctccacccccccccctttaaggggtgggtggagccgcggggaatatttaatatataatatacttattatattaatacatataaatattataataataataattagaataataataattagaataacggctctcatcctacttttgtaggatgagagccgaggagaatgatatattccccgcggattcctttgaatctgcggggttaattatatcaatattttagatctatataaaatatatatcttactaacaaattccctgcaaatgcgactcacccgaccctttatgagggtctggtgatgttgcgcagggtttagatattttatatataataatatatattatattataatacaatatattataatatatggttaggggtccccccaatttatatatcatataaattggggggggagaataaatatatataatttataatttgtgagggttactaattatataatataaaatttattatatatttctatatataatagtaataataatagataaaattagttagcccgcgaataccagatgggggtattcgcgggcaatacttaataatattctttaattatattatatataatataattatatattaaaaataaaaaaaaaaaaaaatagaattattattatagatatgtccccccccccatcaccattaatatggtgatggggggggatgaagaattacttattatctttttattttattagatatataaaatatgttataaattatctttttccccccccaacccataacatgggttggggggggaaaagaatcccataatatatatatattatatccccatcttcctccctgtcgcacacatatggtgcgtagggagggggtagcatagaatggatggaaatcatatatttagtattactatatatatctaaaaatatatttatattgtatatataactttagtatatatataaatatattatttttatataaattacaatatattagttatataagggggtattcccgattttcatagcatggaaatcgggaatttcatataattatagatatgtatacccaatctcatagcatgagattgggtaattatttttttttattatatactctttacctatctttaagggattactattatatttagatataattaataaaaataatattattattaatatttaccccccccccccaattccggccctctctacgacttacttacgtcgtggaggatataagccggaattggggattatataatttaagaatttacccaatgtgtatagtatgcacattggggaatatatatatatataatataattatatattatatactaattatagatattattgaatattattatttatctttattcagataggatagattcgaacgtcggttccataggaaccaaggttcgtaatccatcctatatatttatattattattttaatttattcagataggatagattcgaactaactaactctttctcccaaagaaagcgcctaacccttcggcctctatctgttattatataagcatatttatattatttatttcaatcaaatatatattatatattttattattaattaattaatatttatatatatcaaatatatattatatattattatttatgattatttatattaattatattatattaataatatgacttcctatatatattatatattattattattatataattagcaataatacgagttgaacgtatatgtttaggtcatgagcctaatatgttaccaattacattatattgctataaattgacccattaacgtgggtcatccacacccatataagggtggatgacccgcgtgggtagtatatatataagaaatgaagagaatcgaactctaaatgtgtagatttgcaatctaacagtttaacctttaaacaacatttcctctaacttatatatatgtattatatcaatataataaatattatatctatatttccaacccgtattattataatatgggtcggaaatgatgataattattattattattatttattattttttatattatatcaaccccgcggctaatacccttaaaaggtattaccaggagagaagtccgcggggggacgtcccttaaagggtgtggtaaatatatagggaataataattacttataatatatcccgcccccatattcaattatatatgggggcgggattaactattattatattatttttatattatctataatagttatataataaatatatttaatataaataatataattatatatgaatatatatatatatttatattccccgcgaactcccgatattatcgggagttcgcggggttatatattaattattatatatttaatattataattaataatagttccaattgtaccaataaatacggaaccccaaaggaatattatataatcagttttatattatatattaatatataatatacgtaaattagtattattattaaataatatataatatatatatattatacatatattagataattatagataatccccgcggtatacattatatgtataccgcggggtaaggtatttatgtatttttacatatatattatacatatattaaaagtaaaaattattatatacgaatattagatatattaatattttaaatacccatccccccatccattaacaatggatggggatgggtatttattttattattaatatatatttttatatataaaataataaacaaggacaaagagacttgaactcctaatgattgatttgaaatcaatagttttaccattaaactatatcctctttacccgcgctaatgggtcatctacccccatatagggggtggatgaacccgcgcggggagtatataataattattattattattaattcctacccaaccttcctcaccttcaatatctgcgcaccatgtgtgcaacaggaaggtgagcatgttatgggttggggggatataattattaaattacccataatattgggtagaataaaaaaaaagtgaatatttaagatattaataagcccaccgcaggttcccctacggtaactgtatttcaacttcgcattaattcgtaatatttcttctatataaataattatattaaataattatatataaaataagatatataatataaatataaatttatatatttggaaaatattatgtttcaacgcgtgatgagtgattagtgcgaaacagttaaagtattcaccgtaacatactaatttacgtattactagcaattcttttttcataatatcgaatttcagatattaattcatattatatataatatataaatatattaaagatttaaatgttttatactattaatttattatttatttttaataattatatatagttttgttatcatttaattatagcacgtctatagcccatattattaggatcatcatgatttgtcttaattcctttcatattaaatctattagatttaaaatattatatataatttataaatatatatatggagatttgttcgttcatgaaactaatctaaaactttgcagcacgaactgaagacaacgatgtaacgcctgtaattatttatatgtatatataaataaatatacaaaatatggtaaggttagtcggggatcatcgaattaaataacatgctccactgcttaagtctgtaaccgtctattgtcttgaatttcattcttgcgaacgtactcttcaggcggaacacttacattttcatttttatattattatattatttaataatatatggtgttcatagtttactgctagaactactcgggtatcgaatccgtattgctactctagccttcgttcctcaatgtcagttaattattaattaatattttcacatataccagtcttataattatcattattatttcatctttactattataattctttaattaatattaattaactctaatatataattaatatatatataattctacgaactctttaagccattatgattaacgctagccctcattgttttaccgcaactgctggcacaaattttggttaggactattaaatatatacaatatatataaaataaattatatatattatatacactaaatataaatttagtaattaatatcattattttaattatttatgaactttattgttaatcaataatattataattatttatatttataaaaataaattatatatattaatagataatatatcattctaataagtaactggatcaatctttcgatcattgtccaatattcctcactgctgtatcatatagatattgactatatttcaaagtcaacgtgatcgttctaactttaattatcgattatggattgtcgactaggtataacttttaatttacctactatcataaaccaatattggcttgactataaacaattatatttaggccccgcggccttctctacgacgttagtcgtggaggagccgcggggaatatataaatataatctttatatttataataattatttttattataaataatataaagcatttaactttatttatagttataaattccaaattttactcacgggtacactacatatttattatatggatatataataaacgtttaatttgcatgtgtcatgtccttatttagcgtttaatctgaaccaacatcatgttcttcttattattttattcttttatatctaattataataatattaaatattattattatattacttatatattatatataataattatatatatatattagagatattaaatatataatcccgcgcctcattaatataatattaatgaggcgcgttatacctccgttaggagattatatcaaccccgcggaatactcccctttaagggggagtattccgcggggaatattcttataaataatatatataatgaagaagagttataaatagtaattatatgtattccaatccatgctatactacccccccttcctgtcgcacacacatggtgcgacaggaatatggggggggttaattatatttattatatatatataatacatatatatatagagaaagatatactctcatccatatataatatatatggatggggtctaataatatttttttatttttattattatatcaaatccataggaaatatatagagaataataattactaataatatatcccgccccatattcaattgaatatggggcgggattaataattattctataagccccccgcggctcacccaaccatacggttgggtgatgccgcggggggggagcatatttatattatctataatagttatataatatatatccttaatatttattattttatttttataaatataattatatatgaatatatatttatattccccgcgaatcacccccctttagggggggtgattcgcggggttatatattaattattatatatttaatattataattaataatagttatatttatataatataaattccccggacgcctcgtccgaccctacggtcggacgatggcgtccggggttaatatcttatttccccgaccatatcaatgatatggtcggggtagataaagatatacttattatatatgtaattaatactaattatatagtattatatagtaagttttatcaatttctccacccccttaaaggagaatatataaattccccggacgcctcgtccgaccgtagggtcggacgatggcgtccggggttaatatttatattataaattatatatttattccgcgattccttaatagaaaccgcggaataatttttgcgtgggtctattaatattaatatactatattagtattattattaaataatatatatatcaccccccatggaggggggaggggggggggggaagcgaaaacccccaaacaaacgcccggtctagagcgggggggtacggggggagtatattattattttataaatatatatatataataaagaagtatttataatattgatatataccacaatttcttccccggacgcctcgtccgaccgtacggtcggacgatggcgtccggggtttatataattattaatttattaattatataatatattatattataattatattgtaatattaatatataaaatttatatatcctcttaaagtggttaacattataatgatttaccccgcgatattaccataaatatggtaatatcgcggggattataatatatcttattcgtataatttttatattaaatatatatacatatatattcaatttatattagtctttattagtccccccccgcggctcacccaaccctacggttgggtgatgccgcggggggaagatgaatattaatataatgatttatcccgcgatattaccatatttatggtaatatcgcggggattataatatatatattttatatataatataaatacatatattaattatatatttattattttattatatatataggtatatataatattaatagtgccaaagaataccgaataatatgataatagatataatatatacccagccataatatagcatattatggctgggtaattaattatagatatatttcccgattagcatagcatgctaatcgggaagttatttttataatactataagcgtagtatatcatagaaaggaaggagtatataatcccgcggatcattatgatccgcgagaaaacgtgattttctaattatactgataatattaatatataaaattatatattataattatataatatattatatatgttttagtaaccccgcggctcctcccctttaaagggattactaggagaccgcggggaaaatattaaataatattatttaatattatttaattaataataatttattttaaagttacataccccgcggctcgtttccgggatatcccggaaacgagaccgcggggaattataaaataatataaaccccgggaaaaatatatataataatgttttttcatatattctaccttctatatattaatattactcctttgggactattattataataatattcaccctgataaaaatcagggttcgcggaattaaaaacattggaatatttttaatataataaaaatataattaattattattatataccataggaataaaattatatattatatgtaatatgtaatcccgcggtatactttatatgtataccgcgggggggggagagatataatttataaattttatttaatataatatatatattaaataaaaaaaagaatattgaaataattttattattaattactatttaacatttttaaaattaaaatattttccccgcggactcgtccccgggataccccggggacgagccgcggggtttatattattttcataattaaataatactttttttaattttaaactattactcttccccacgcggctcatccaaccctttatgagggttggatgatgccgcatttgcggggcttctaaatctaaatattcaaataataaatcccccgcggtctcatcctctgggattaccagaggatgagccgcggggttaattatgttttgattttacttcattataacatttataatattcttccccacgcggtacacccaaccctttataagggttgggtgatgccgcatttgtggggcttattttgatttaaatttaatcattattaatattttgagaataatatcttttttgattattattaaaaatagataaaaaagaatattgattagttaaattattacctttaataattactttgcattttttctacctacatagaataatacattttcaattgttgatacaactggtacaataactaagaagtatgcaaaataaattacagtagcaatttgtcccattacaacaaaaggaggctctacatgacattctcctaagtggcctaataatacaaagttagcaataaataagaagaagaagaatttagagaatactttaaatgcgttacctctaataacacttctatctgtaataggtaatactaataaaattaaaatagcaccaaacatagctaatactcctaataatttatcaggtactgatcttaaaattgcatagaatggtaataaatatcattctggtacaatagatgcaggtgtaactaatggattaccaggaatatagttatctggatgtcccattgtattaggtgagaagaatacaaataatgagaagaagaataagaatacaaatacagtaattaaatctttaaaaataaagtaaccatgcattggtaatctatctaaattacctgtaacacctaaaggatttgatgaaccatgtgtatgtaatgccataaaatgcataattacaaatgcagcaataataaatggtactaaataatggaaagcgaagaatctttgaatagtaggattagaaactgagaatccacctcataatcatgatacaatatcattaccaataaatggaatagctgagaataaattagtaataactgtagcacctcaatgactcatttgtccatatacacaacagtatcctaagaaagcagcagccattgttaatacaaaaataataacaccaacatttcatactaatgttctaggagctctatatgaaccataatataaacctttaccaatatgaatatacatacaaataaagaagaatgatgcaccattagcatgagcatatctaataaatcatcctccttgaacatctctcataatatgttcaacagctgagaatgctaattcaatattagatgaataatgcatagctaaaaaaatacctgtacaaatttgaattactaaacataatcctaataatgatcctaaatttcatcaataattaattgatgaaggttgtggtgaatcaatcatataactatttaataaatttaaataaatattagattttctaaatgacatattttatttgaattattatatttttaaatatatatataaatataatatatattaaatatataatataaatattatatattccccacgacgaacgtcgtggaggagccgcggggcccttatataaatatgacccccgcggatcacccgaccctttatgagggtcgggtgatgccacgggagaaagggataaatatataattataataatataattatgtataatttatatatattatttatatgaatatccccgcgaaattatttataatttcgcgggagataaataaatattttataaatataatattattgtattatatatataataatatatatataataattattataataatataataaatatattattatcaagtaatttgatacatatataatatatatgtatattgattattattttataattatatattacttctaatatatcccacggatatacttggtaatatatccagcccccgcgacatgaccctttatgagggtcatgtcgcgggggagaagggattataaaatatataaccttaatcggaattgaaccgatattttcaacatgaagagatgatgtcgtaaccattagacgataaggtctgttatattagagattcgaactccaaacctttcgattacaaaacgaacgctctaccaattgagctaatataactactattaacttatatatagattccccccgcggcctcacccaaccgtagggttgggtgtgccgcggggggtaagttaattaaaactatctcgctaaattatccctatttaagggaactaatttattattttatatatatagaatatataaaaatatatatatatatattatgaaaatatatgcctaaaaggcgaattgtaatttcttccccggggctcacaacctaggttgtgagccgcggggtaatcattatttattaattttattatataatatattaatatataatatacaaaaatatatatatatatataatcctcgtatttcaacccataaggaattgggagattatataatatgtaataaaagggtatatataataatagaataccccgccatattgccaatattggcaatatggcgggattatgtaaatatataaactcccgccattagtcgtatgactaatggcgaaatactaatttattattatttttatataaataatattattatataaaaatttatatcaaagccctatacgaggtatttggttactattaatatagatataatatctataaaccccccccttaaaaggggggtaagatattcccgccataatatatcccttagggatatattatggcggagtataaataataatatcaatatttattattaaaaaaattattatatatatttatatatattttaataattaatattattaagaatatatatataattctttatttaattttagccccccccgcggtctctcacccaacgaatgtagggtgatgaaccgcggggaataataatatttatatatatttatatatattttatacatataaaataataatcttatccccgccatatatacctattaggtatatatggcgggaatggatataatgatatataatattatatatatatttttataattatttcgtagaaataatattatgaatataaggctatacccgccattattaccaatattggtaataatggcggggtatatatttatttatagatctttatatattaaatatataatatatatgagaagtataattcccgccattatctattagataatggcggggatattaatcccgccatatatttattataataaatatatggcggaatactaataaattaataaatatataataataattataatatttatttaaatatataaatatttatatattaaattcctatgaatgatattgcatttgcagagttgaatataattaaatataaaattcccgccattagtcttaagactaatggcgggatatatatatatatatatatatcttttatatatattatatatttattttttataatatatataatatataattatataattatataattgtataccgccccgatatttattataaatatcgggggcgattattgtcatattatatcatatcctatattatatataattattatatatatctattaataataatacatattattccccgcggctcatcacccatacattcgttgggtgagagaccgcggggggataaataattagggaaattatataatacaatatattatatacaatatttatactatattaatatatataatatatattataatatattaataataataataattatattattaatatctagaatatatatataaattactatataatatatataatagttatataattaagtattcccataacatgggaatcgggggattatataatataatataataatgtcgtctttcttattacgtattagattgtatataattatattataaataatataaaccccgcatttgcggggaagataacaatattatataggttattccgcggaattataaccattagggttataattccgcggaatacattaatatgtataatatataatatatatataaattactaataatatttataatattatatataatatatttatatatttatataattggggcatataattattttatataaccccgccatatagaccctaatagggtctatatggcgggaatggttataataatataatatttatatattatatataatatatttatataattaaattaatactctaagaagtaatattacccgcggatatactacgagaatatcgtagtatatccgcggtaaaggttattaccgccattagtcatacgactaatggcggggtatatatatatatatatatattcttacataaatctaatatatttaatatatatattcttctagggttataaatatataatttccgccattatatatttaatgttaatggtgagatataccttttatgtatgttccaatatatatataatatatataatccccaccccccctttaggggggggtggaaggaggaacaagataatttatttagtttccttgcaaatgcaactaattcaatcgaagggtttataataatatttaataataataataatattatattaataatttatatataaatcttaaatattatataatacaatatattctttaatatcttttttttttcctatggggggaatatagaaaattattaatatagtttcataatataggtacatgtataagataatatctattataatatataaataataataatatatatattataataataataatatttccccggacgtccgaccctttatgagggtcgacgcgggttgttataatttcccgcggataagccattaggcttatcgatacattcatatctataatacatatataaattatataataaataatatataaataataataataataattatatatgttatcacctactttattagaattataaatacaatatttatatgtataatatatataatatatatagtctcacaaatgacttataatatatataataaatataatatataaataataaaccccgcggactcctacccctttaaagggggggaggagtccgcggggagactactttttttaaagaatatataatagttattcctgatttatatagcatgtatattaattgtgtgtgacaggaataaatttagcccgcggttctcatacatacatacatacatacatacatacatacatacatactacgaaagtaggatgatgagtccgcgggaatatatatatatatattataatatatatatattaattaaaaaatataagaatattgaaataattattttttaataattatattattaatgtaagtataaaacatcttttaagtatgaagatgttaaaatagatcatacataagcttgaattactgaaatagcaaattctaatacaacaatagctaataatcctacacctggaattaaaccaaatacgaatgtaataatactcattgacattaaattaaataataatcctcctaaaataattaataataaatgtccacttaatacattacttgataatcttaaacctaaagaaatagctctagcaaaataagataataattcaattaatactaataatggaactaatggtaaaggagtaccacctggtacaaataatgagaagaatactaaaccatgtttagttaaaccaataattgtagcacctaatcaaataactgaacttaatgaaacaataaagattaaatgtgctgataaagcaaatgaataaggaatcatactaattaaattactaacaaagataaagaagaagaatgtataaactaatgggaaataatatcctcataatttaccaccaatttgtcctttaaccatatttaaaatagtatcataaatagcttcttgtgatacaaatcattttgaaccaataattttattattattagttgttaataaatttaaacctaatactgtaaataatacaataattgtatataatgagaatgtagtgaaatttaaactactgaaatctaataatggagatgtaaatcccattaatactctaatttcaaattgatctaatggtgatgtaataaataaatttaacattttattttattattattattaaaaatctaatataaaatatatataataatatatataaaccctcccttaaagggggggggataagatataaatatcttgttataaatatataatataataatatattgttatataatatattattataaataataatatatataaatattgaataattaattacctggaaatgcgactcacccaacctttcggttgggtgagtcgcgcaggatttagatatacctttattcgtgacccatcctcaatattatgttgaggatgggccgcaggtaatatatattaattataaatcccgtaaatttcaatataaaattttagggaaacatattattattataaataatatgaaccccgcgaattacggtatagaccgtaattcgcgggaaaatgatatatgtataattataattttgaaataaataatcttgatacatataatcttaaaatttgtggtaagaagtattgtgcaaataatactaataaaatagtaactaatgcaaaaccatatactaattgatttaagaaataaaatggtactaattgtggcatatttatttttatattaaattataatttactattaatattattattaatattaatataattatataaaattattatatattaataatattaatccttcccccgcggaatacctcagatatctgaaggattccgcgggattattaggactaatatttatataaaaaaagtatatatatgaatatatatatataatataatattatatatattgtatataaatcatccttataattctatgtattataagggtgtactattaagaataatctttcaccccgcggctacgacatatatcgtagccgcggggggggggtcatatttataaaaagaatattaaaaaagataataatataattattatgattgtacagctggagtattaaatgtatgaacagctggtggagaagttaataagaattcaattgatgaagatttaattttattagttgcgaagatttgatttgattcaacaaaatcaggtcctttattataaattactgatttattattaactttattttctaatccattaactaattgatcatataaaatatagataaataagaataatgagaatacagcaataattgaaccaattgaagctacataatttcaacctgcaaaagcatcaggataatcaggaattcttctaggcataccatttactcctaagaaatgcataggtaagaaaataacattagctcctacaaaaattaatcagaattgaatttgtgctaatttttcattataatataatcctaaaatttgaggacttcagtaataatatcctgcaaataatgagaaaatagcacccattgataatacataatggaaatgtcctactacataataagtcttccccggacggctcgtccgaccatacggtcggacgatgccgtccggggtttatattctttatttacataaaggattggactatgtcttaataatatataaccaatatatgtatcccgcgaattccactttaagggaaattcgcgggaaatataatacatattatatatattatatatatattgataattatatattattattcacgtatagtctctacagttcccattattatataaaatataataatggttaccacgaaattgtcttatataattgtagtatataaattacattaaatttatttatataagatttcttcgttagctatatttattaaaaaaaaatataacccttaatatatcattccccccccaacaccttataggtgttgggggggggggtataaagataattaagatagtgaatttactacatgacactttaaatatttattttttttcatttaatatattcaatatatttataaccttgtaaattatatttattaaaaaatttaataaatatattaatataatatttattatatacctctaaaatatatatattatttttatatattaatttattcttaatattaaaataattttttaagaattctattaaatgtttatcatttatataaaataaaaatgaattattattattctttctaataataaatttacctttattttcaataaaacctaaaaatcatacattaatataattatgattataattattattaatattaatattaatattaattcccgcgaactttttatggaagttcgcgggggaaaaataattaattttagtataatttatatctttataatatttatataaattaggattatatttattatttctatcttttaaatataaatttattgctaaatttctattatttttataaatataatatatagattttataaatgctaattgtaattttttatttatagttattaatggatatttattaaataatttaattaaattattaatattttttatatcatttataattcatattacataattattattaatattaatattaccttttaaataatgtttaatattatttaatatattaatattctctttattattatttaatttaataattaatctaaattgtaaatatttagatttatatttattaatttgaatattaccattactatcaaataatcctacaaataacattttatagaattctgaccctgcggttcatcttccttgtggatatgaaccgcagggaatactattattaatataattattattaatattattattattattaatattattattaatattataaatattattagtattattaatattattagtattattaatattactatcactattactattactattactattactattccccgcggctctcattctactttcgtaggatgatgagtccgcggggttattattattagtattattagtattattattaatattatatattttaatagagtataaaatattattaattttataaaatgtggtaggattatataaattacagtatttcccattagagaagggataagtataaatatatgaaatatataatataataattataatatttattttatcatggaatgctacatctaatgatgcatttgctaatgctactcctgttaatccaccaattgtgaataagaataagaaagcaatagcatataacataggtacagctaatctaattgatccaccataaattgttgctcttatttttaaccttaaatcatcacagattcatttataatatttataataaatattataatagctagttaaatttatatataattatttattattaatcccaatatcctccaaatatttggaggatattgggtaactatatatattaggataatatatatataatacatatatatattatttgaaggattgcttcaaaactattactagttccattggatcattccttatgtattcatataatagacccgcaaaatatttcctgcaggaaatattttgcggggaatatattacttagaaataccagaagcatctgatctctacgcttttatatatataatttcttatatataatttagttcgacgattgccctatataaattctaatttatatatataggatttctctcgagtttgcttcttaatatataaattatatatatattatatagattatatatattaccccgcggattcatattatgaatccgcgggattatattatttattattatatttatcatatttttgtaataatttatattcaaatttatattttatagatggaataatataatttttaatattaggatataataatttaatagatttaactttaatataaataacataatatgatttatgtttatgtaaagtacaatctaaattaaatttaatttttaaaatattaataaaataaattaattctttaatagtatatgattgtaaatttaatgtaatacctccacctttattaaatgaaccatctcctataataatatgagctaatgattcataatttaataaatcatataaatcatttggtataatttttactctaccattataaaaatgatgtcttaatttagtaaaacaaggtaaagctatagtagttatttcaactccataataaattttaccttttaatctttccccgcggactcctcccctgggattaccaggggaggagccgcggggtgttttaattaattttggaggacttacacaataatgatttaatttattatatacatataaaacatattctacttgttttaaagtttgtttaaattttaatctactattaattaatgtattttttgaactatattcaattcaaccatctgttaataaaattccattaattatatatataatattatttggaattttaattatatatttaattattatagtattattatattctttatttattaaatttgaatataaattagtaccataaattgttaattttttattataataattattattattattataagaattataagaattattattataaatcttatttatccccgcggtcatgttaccgataaccggtgactgaccgcggggattattattattattattattattatgattattattaatatatatatattttatatattttttgatcaacttaatactcttgctaaaggagtttattaatcatgagaaaattttaatacctgtaggaattgcaataatcattgtagccgatgtgaaataagctctagtatctgcatctaatcctacaatatacatatgatgtgatcatactaagaaacctaataatccaattgaagccatagcatataccattgatacttcaccgaatactggttttttagaataagttgatacgatatgtgaaataataccgaatccaggaataattaaaatataaacttcggggtgaccaaagaatccaaatctaaataatatattatcttttccccaaatattatttttgataatagcacgggtagactctataatatatatctcatatataatatatgaccttattattaataagtgattccgactgtacattaagcaatattattatatcacccattggtgaagcagtctgtagcgatcagaatatataattatatatattataaccgacggtctaaatctgagaaattgttgaccgtaccaccaatgttgcattatataatatatatataatactagaaaatagtatatttatctcttctccccatatcttcttatcagcttagctgggaagaagatatggggggggtattaaaaaaggtaaatcccttggatggtgtccgaataagagaataataaatatttagtctcttaatttatatatatatattaagagagatataatctttttatttttcatatcaacattgttatatcttttctaattaacttaagttaaactatttcctttgtttcaatattttttatttatactaataaaatatgattatttattaattaattccctgcgcgactcacccaaccctttatgagggtcgggtgatgtcgcgcagggtttagatatttttttaatatataatttttgttcttcatttaaaggtttattttgtttataataatttattacatgaataaatttatctaaactattagatttatcagataataaaggatattctttaaaataatttaaaataaaaatacaattatttaatcctgaaattcataattgtcaattatcatctttagaattagaataaactttaccaatatttttttcactattaatgttatataatgaattagtattagatttatcaataaataaatttaaaatatgttctaatacatatttattaacaatatgtttttgacttaatgcatataaaaatctaggtgtatttttattatcttttaaagaaatatcaaaacaaccttcagcatcagtaaatccagataatcaataatcatttaaagtaggtaatttacaataattttttaaaataattataggttcattattttttaataatttttcatttaatttagctaaaaaaattataaatttaccatatctagtaggtaatactaaattaccattaaaaattaatgataataaataaatatctcttcttttatgtactactcatctatatgttatatcttttttagattgtaaaattacatctcctatattaaaattatttttaatataatttaaaatttttatatctttagaagttacaacaacagaaatatcacttctttttattaaaataaatgaacctttaccttcaaaaaatcctacaaatcattctaaaaatttttgatcaggaacagaatttataggtttaaattctttatattttaaattaaattcatcaaaataaaatttatcttgattaaattctaaatttttaaatgaagataatcataaattaatattatatttataatcataaattactatataaaatggcatagaaaacaaatgttggtataaaacagggtcaccaccacctgctacttcgaagaatgaagtattgaagtttctatctaataataacattgtaacacctgctgataatacaggtaatgataataataataagaatgctgtaatgaaaatagatcatacaaataatggtaatctatgcattgtcataccatttgttctcatatttaatgttgttacaatgaaattaatagcacctaataatgatgaaatagatgttaaatgtaaagcaaaaattgctaaatcaacactaggtcctgaatgtgcttgaattgatgataatggaggatatacagttcatccagtacctgcaccagattctactaatgtagaagttactaaacatactaaagcaggtggtaaacatcagaatgaaatattatttaatcttgcaaaagacatatctgatgctccaattaataaaggtaacatatagttaccaaaaccaccaattaatgccggcattactaagaagaaaattattaagaccgcatgcccaactactaagacattaaataattgatgatttccgcttaaaacttgattacctggtgcggctaactctaatctaatgattaaagacatggcagtacctgccataccacagaaaatagcaaagataaagtataaaacagcaatatctttagcatttgtagaatataatcatctttcgatcattaatttatttttataattattatattatatttaaaatatataatataataaactattattattagttatatttacccgcggctccccccctgaaggggggggggagccgcgggattagtatgtaatatacattatgttttttattattaattaattaattagttatatataattattattataattatataattatagataaattcttgacccccgcgctccttcccatccctttatgggatgggaagggagcgcgggggataaataagttttatcttacttatatataatttatatatataaaaatatataaatttaccaatttactatgcagatcggtaaaaatatacatttccccgcggtttcaccccccccttaaaggggtggggaggaaccgcgggggttatattaattaatttaatagatattatgtgaatagtcggaataattattctattaatatataataagcctcttaaagaaaaatattattctaattatattaataataaaaaataaataaatatattaggtagggcttatttcccaccatatggtgggaaataagcccccctcattagtattattttatataataaataataatattataaataaatataatatataattatattaaaatatatatatgtatattaatccgcgcctcatcctttataatggatgaggcgcggataatacttttcccgcggactcctttaaaggagtccgcgggggtttattattaatattataatatataataaataagaattaccccgcggctcatcaccctacattcgtagggtgagagaccgcgggggaaaaatattattataataattaattattataataatggttatcctaaatttattactccctactcccccccttcaatatctgcgcaccaatcgtgtgcgacaggaaggggggggagtatagcatgagatcaataaattatttttatactcttatttatatataattattattatatttaaaaatataatataatataatataatataatataataattccgcggattcataacatgaatccgcgggatataaaataagtaagaatccccgtctccttgtgggtcgggaaggtgaccgtggggaaacccctaataatattgtagggtttgcagggaaagaatattattatatataatttattaattataaattatataattattgttcatttaatcattctaagaatgctggtaatgaaactgcttcaattttaataggcatagctgaatgtgattgtccacaaatttctgaacattgtccatagaatacaccttctctttgaattaaagctgatacttgatttaatctaccaggagctgcatcaattttaatacctaaactaggtacagcaaaatcatgaataacatcagctgctgtaacaacaaatctaatatgtgtatcaacaggtactactactgaagtatcagtatctaataatcttaattgaccatcttctaataaatcttcaggaataacatatgattcaaattctactgtttcaccattatcattaatgaaatctgagtattcatattttcaatatcattgtaaaccaatagctttaatagtcattgctggagaaataacttcatcacataaatataataaaatgaatgaagggaaagcaataattaataaaattacagcagggaaaattgttcaaataatttcaatagtttgaccatgtttaatatatttataagcaataggatttttactataagttcttacaattgtaaataataatcatgatactaatcctaaaataataaataaatagaacataatattatcatgtaattctaaaataccttcttgattaggtgtagctgaatcttggaaatacataccataaggtgtaggtacatcattcataataattgaatttaataaataaaacatatttataattttttttaatctatatatattctatatattagatattacattgattaatatattattctcccgcgaactcatccaactaatgttttgatgagttcgcaattaggaaaaaaacttattaataataaattattataaataattataataatattaaataagtatattgatatattattattaaatttttatattttaattgatatatttaatatatattagagatacgagatttgaactcatgtccttcgcgtgtaaaacgaatgctctgccaattaagctaatctctattattattattataataatattatacttacttatatctatataataatattatataataattattataaattcccccaattgcgtattcctccccaccccccttaaagggggtggggtttattaattatattaactccggggactcttcccaggtatacaccttatgggaaggagtccccgggagaagagtatataaaattatttatacaccccgcggcttattccctggaattccagggaataagtccgcgggaaaagtattataaataaattaataaataaataaataaataaataaataaattattaatactaataataagtattataccccgcgggaaaatgtatattatatatttatttatatataaaattaataatataaaattaatttttattagtatttagaggtccttaaggaaatagtaaggagaacgcgggaaagatatatattaatttattatatattataaaatatttatatttttaccccccccttcatataatatgaaggggggattatatgtatatattaatttattatatattatataattatataattataatataaagaaagaagccccacgcggcattaccctagggtaatgccgcgtgggggaagaatattgattatttatttattattattaattaataaattaaatagtatttaatttaactttaatattatatttaccatttttattaacatcagaaatattagtaatattatggttaacagggatataatttaatttataattattaaccatttgattacctcaaatatatttatagttttggaatgtaccatttaaaatattcattgtattagatctagaaatagatttattattagataatctaccttttaattgaattgatcatcctactaaatatttaaacattaaaatattattagggatagtattaatattattattttcataaataatattatataatttccccgcggctcctcccctgggattaccaggagaggagtccgcggggttattattattattattattaattgatttaataatattattatatttattaaacataatattattaatattattaatatatgtttgactaattaatttatcatttaatttaggcatattattcattaaatttttaattctattcattgataaacttcttttagaagatgaattcataatttttaatgatttagctaaaatatcactattcatataattatattttaattgaataggttcaaatgatacatctttattataatataatgataaaatattactaatactattaatgttattatttaataaattaattaatttactattaatattaaatttataattactataaatattattaattaaattattgttattattaatatttttattaatatttttatatgataaataatagaaaaatttaatattaactttattaatactatgttcaaagataggtttagaaataattaatttataaattttattattaatatttaatactaataattttgttaataatttagttactaatctatcataaatagtattattaatttcttcagttttattaaatttataaatttgagatgatcaagaattaatattatttaaatgttgtaattttacacctttattacttaattcatttaaataatctcaaatataagttttatttaaagatctatttaatcttttattatttaataataataataattcttttatagaatttaaattgtttatattattaatatttttaataatatttaaatttgttgtatgtttattcattgtatttatatttatttatatatattgatcgtataatatatatatataaaactatatatatattattattaaattattaaaaaatttaacatgtttattatatttactacttataaatataaaataaaatatttattatatattttataaattatgtatattccgcgatatcatcatatgatgatatcgcgggaaagagataaattcccgcggatcctctactggtaataccagtagaggatccgcggggtaagataatatattctatttataattattattaaagagataatctattttatttcccccccccccaatctcatattatgagattggggggaatcgatatataaaccccggacgccatcgtccgaccgtagggtcggacgaggcgtccggggaattgtatttatttatatagatctattatatataataatataattattaatcgccaaatacccctattataggggtatttggcgatactagatatatatttaatattactaataatatactatatataaatagttttcataattaacttttccccattgcggactcctcccttcgggggggggggagtccgcaatggggtttataagtaagtataatataataataattatattaaaatataaatattatcatatatatatatattatatatatatattaagtaatattatttctataaattaaattaacatttaaatttataaatgtatagattataaaaatatttatgacacatttagaaagaagtagacatcaacaatttccctttcatttagtagctccatcaccatgaccaattgtagtatcatttgcattaatgtcattagcattatcattagctttaactatgcatggatatattggacatatgtatttaatttatttatcaattttaacagtaacattaagtgctacattatgatttagagatattattgctgaagcaacatatttaggagatcatacaattgctgttagaaaaggtattaatttaggtttcttattattcgtagtatcagaaattttaattttcgctgcattattctgagcttatttccattcagctatgagccctaatattgaattaggtggtgtatgacctccagttggtattcaagctgtacaacctacagaattacctttattaaatactattatcttattatcttcaggtgctactattacatatagtcatcatggattagtaggtggtaatagaaaaaatgcattatcaggattattaattacattctgattaattgttatttttgttacttgtcaatatatcgaatatactaatgctactttcacaattactgatggtgtatatggatcagtattctatgctggtacaggattacatttcttacatatggttatgttagcagcaatgttaggtattaattattgaagattaagaaactatcatttaacagctactcatcatgtaggttatgaaacaacagtgttgtactgccatattttagatatcatttgattattcttatatattgtattctactgatgaggtgtataactcatcagtacaatatataagaatatctttaaacaataatattcttaccttttttatattaaatatataaataaatatataatataatattaatataatactattataagtattgcccgcggcaatcctaaataggattgccggggaattagaactacccgtggcacccccccaagtatatcctaaaaagccccccgtcaaatatattataatgtgtcctagatatatttatttattatgacgactattaataatatgaagtacaagcccaatgtcatcaggggggaggggggggatttttttttttttttaaaaaaatagttcgtagcgtactatcattttttttttttttgggggggggggggagggtgaaaaaaaaaaaaaaccccccccctcctcttattatccctcatatccgaagtggtacttaactctaagaataagacactagttttttatttataatcgttatatatctttttcctcgctctctttttgttaatattgattattcttttctttttattttattattgttattaaattttattttcctatatatatttattcattaactattctttatatttcattatctccctttagactatcttacacagatgctacctaattatttattctgtaatattttctctttatttttgttttgttgtttttttttatgttttatattcttctttatatcttaacaaatgaagttagttttataaggaatctggatctttttaagttatcggtcaatcaccgcttttctgatcagtaaataatcactaatacactttactctgcctctatgtgtcatctcctccaaccctttctcctcctattttcttctttataattttatcatttgctatttttattttttaatctattttatattttatttaatatgttttgttattctattttatcttatttt

SEQ ID NO: 7 - skipped

SEQ ID NO: 8 - DNA, 20 bp, Artificial Sequence
  Synthetic construct
tttttttgttttttatgtct

SEQ ID NO: 9 - DNA, 4932 bp, Artificial Sequence
  Synthetic construct
cggccagtgagcgcgcgtaatacgactcactatagggcgaattgggtacccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaattttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttctagaactagtggatcccccgggaaaaatggacaagaagtactccattgggctcgatatcggcacaaacagcgtcggttgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgatctcttctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgccaccgcggtggagctccagcttttgttccctttagtgagggt

SEQ ID NO: 10 - DNA, 5189 bp, Artificial Sequence
  Synthetic construct
aagcgacttccaatcgctttgcatatccagtaccacacccacaggcgttttaccgttcgtataatgtatgctatacgaagttatggtaccttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagacaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatggacaagaaatactctattggtttggatatcgggaccaactccgtcggttgggctgtcatcaccgacgaatacaaggttccatccaagaaattcaaggtcttgggtaacactgacagacactctatcaagaagaatttgatcggtgctttgttgttcgactccggtgaaaccgctgaagctaccagattgaagcgtaccgctcgtcgtagatacactagacgtaaaaaccgtatttgttacttgcaagaaatcttttctaacgaaatggccaaggttgacgactctttcttccacagattggaagaatctttcttggttgaagaagacaagaagcacgaaagacatccaatcttcggtaacatcgttgacgaagttgcttaccacgaaaaataccctaccatctaccatttgagaaagaagttggtcgattccaccgacaaggctgatttgagattgatctatttggccttggctcacatgatcaagttcagaggtcacttcttgattgaaggtgacttgaacccagacaactctgacgtcgacaaattgttcatccaattggtccaaacctacaaccaattattcgaggaaaacccaattaacgcttctggtgttgatgctaaggccatcttatctgcccgtttgtccaagtctagacgtttggaaaacttgattgctcaattgcctggtgaaaagaaaaacggtttgttcggtaacttgatcgctttgtccttgggtttgaccccaaacttcaagtccaacttcgacttggctgaagatgccaagttgcaattgtccaaggacacctacgacgacgacttagacaacttgttggctcaaatcggtgaccaatacgccgacttgttcttggctgccaaaaacttatctgacgctatcttgttgtctgacatcttgagagttaacactgaaattaccaaggctccattgtctgcttctatgatcaaaagatacgacgaacaccaccaagatctgactttgttgaaggctttggttagacaacaattgccagaaaagtacaaggaaatcttcttcgaccaatccaaaaatggttacgccggttacattgacggtggtgcttctcaggaagaattctacaagttcatcaagccaattttggaaaagatggatggtactgaagaattattggttaagttgaacagagaagacttattgagaaagcaacgtaccttcgataacggttctatcccacaccaaatccacttgggtgaattgcacgccattttgagaagacaggaagatttctatccattcctaaaggacaacagagaaaagatcgaaaagatcttaactttcagaatcccatactacgtcggtccattggccagaggtaattctagattcgcttggatgaccagaaagtctgaagaaaccatcaccccatggaacttcgaagaagtcgtcgacaagggtgcttctgcccaatctttcatcgaaagaatgaccaactttgataagaacttgccaaacgagaaggtcttgccaaagcactctttgttgtacgaatacttcaccgtctacaacgaattaaccaaggttaaatacgttactgaaggtatgagaaagccagctttcctatccggtgaacaaaagaaggctattgttgacttgttgtttaagaccaacagaaaggtcactgttaagcaattgaaggaagactacttcaagaagattgaatgtttcgattccgtcgaaatctccggtgttgaagaccgtttcaatgcttctttgggcacctaccacgatttgttaaagatcatcaaggacaaggactttttagataacgaagaaaacgaagacatcttggaagatatcgttttgaccttgactcttttcgaggacagagaaatgattgaagagagattgaagacctacgctcacttgttcgacgataaagttatgaagcaactaaagagaagaagatacactggttggggtagattgtccagaaagttgattaacggtatcagagacaagcaatccggtaagactattttagactttttgaaatccgatggtttcgctaacagaaactttatgcaattgattcacgacgattctttgactttcaaggaagacattcaaaaagcccaagtctctggtcaaggtgattctttgcacgaacacatcgctaacttggctggttctccagctattaagaagggtatcttacaaaccgtcaaggtcgttgatgaattggtcaaagtcatgggtagacacaagccagaaaatattgtcatcgaaatggctagagaaaaccaaactactcaaaagggtcaaaagaactctagagaacgtatgaagagaattgaagaaggtatcaaggagttgggttctcaaattttgaaagaacacccagtcgaaaacactcaattacaaaacgaaaagctatacttgtactacttgcaaaacggtcgtgacatgtacgtcgaccaagaattggatatcaacagattgtctgactacgatgtcgatcatatcgtcccacaatcgttcttgaaggacgattccattgacaacaaagttttgactagatctgacaagaacagaggtaagtctgataacgttccatctgaagaagttgttaagaagatgaagaactactggagacaattgttgaatgctaagttgatcactcaaagaaagttcgacaacttgaccaaggctgaaagaggtggtttgtccgaattggacaaagccggtttcatcaagagacaattagtcgaaactagacaaatcaccaagcatgttgctcaaatcttggattccagaatgaacactaagtacgatgaaaacgacaaactaattagagaagttaaggtcatcactttgaagtctaagttggtttctgacttcagaaaggacttccaattttacaaggtcagagaaatcaacaactaccatcacgctcacgatgcctacttgaacgctgttgtcggtactgccttaatcaaaaagtacccaaagttggaatctgaattcgtttacggtgactacaaggtttacgatgttagaaagatgatcgccaagtctgaacaagaaattggtaaggccactgctaagtacttcttctactctaacatcatgaactttttcaagactgaaatcactttagctaacggtgaaattagaaagcgtccattgattgaaaccaatggtgaaactggtgaaattgtctgggacaagggtagagatttcgctaccgtcagaaaggttttgtctatgccacaagttaacatcgtcaagaagactgaagttcaaactggtggtttctctaaggaatccattttgccaaagagaaactctgacaagttgattgctagaaagaaggactgggatcctaagaagtacggtggtttcgactctccaactgttgcttactccgttttggtcgttgctaaggttgaaaagggtaagtctaagaagttgaagtctgttaaggaattgttgggtatcaccatcatggaaagatcctccttcgaaaagaacccaatcgactttttggaagctaagggttacaaggaagtcaagaaggatttgatcattaagttaccaaaatactccttgttcgaattggaaaacggtagaaagagaatgttggcctccgctggtgaactacaaaaaggtaacgaattggctttaccatctaagtacgttaacttcttgtacttggcttcccactacgaaaagttgaaaggttccccagaagacaacgaacaaaagcaattgtttgttgaacaacacaagcactacttggatgaaattattgaacaaatctccgaattctccaagagagtcattttggctgatgctaacttagataaggttttatccgcttacaacaagcacagagacaaaccaatcagagaacaagctgaaaacatcattcatttgttcactttaaccaacttgggtgctccagctgctttcaaatacttcgacactaccattgacagaaagagatacacttccaccaaagaagttttagatgctactttgattcaccaatctattaccggtttgtacgaaaccagaattgacttgtctcaattgggtggtgattccagagctgatccaaagaagaagagaaaggtgtaaaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttggcgctatcttaattactctggctgccaggcccgtgtagagggccgcaagaccttctgtacgccatatagtctctaagaacttgaacaagtttctagacctattgccgcctttcggatcgctattgttgcggccgcttgcccatcgaacgtacaagtactcctctgttctctccttcctttgcttt

SEQ ID NO: 11 - DNA, 5589 bp, Artificial Sequence
  Synthetic construct
aagcgacttccaatcgctttgcatatccagtaccacacccacaggcgttttaccgttcgtataatgtatgctatacgaagttatggtaccttttctttttttgcggtcacccccatgtggcggggaggcagaggagtaggtagagcaacgaatcctactatttatccaaattagtctaggaactctttttctagattttttagatttgagggcaagcgctgttaacgactcagaaatgtaagcactacggagtagaacgagaaatccgccataggtggaaatcctagcaaaatcttgcttaccctagctagcctcaggtaagctagccttagcctgtcaaatttttttcaaaatttggtaagtttctactagcaaagcaaacacggttcaacaaaccgaaaactccactcattatacgtggaaaccgaaacaaaaaaacaaaaaccaaaatactcgccaatgagaaagttgctgcgtttctactttcgaggaagaggaactgagaggattgactacgaaaggggcaaaaacgagtcgtattctcccattattgtctgctaccacgcggtctagtagaataagcaaccagtcaacgctaagacaggtaatcaaaataccagtctgctggctacgggctagtttttacctcttttagaacccactgtaaaagtccgttgtaaagcccgttctcactgttggcgtttttttttttttggtttagtttcttatttttcatttttttctttcatgaccaaaaacaaacaaatctcgcgatttgtactgcggccactggggcgtggccaaaaaaatgacaaatttagaaaccttagtttctgatttttcctgttatgaggagatatgataaaaaatattactgctttattgttttttttttatctactgaaatagagaaacttacccaaggaggaggcaaaaaaaagagtatatatacagcagctaccattcagattttaatatattcttttctcttcttctacactattattataataattttactatattcatttttagcttaaaacctcatagaatattattcttcagtcactcgcttaaatacttatcaaaaatggacaagaaatactctattggtttggatatcgggaccaactccgtcggttgggctgtcatcaccgacgaatacaaggttccatccaagaaattcaaggtcttgggtaacactgacagacactctatcaagaagaatttgatcggtgctttgttgttcgactccggtgaaaccgctgaagctaccagattgaagcgtaccgctcgtcgtagatacactagacgtaaaaaccgtatttgttacttgcaagaaatcttttctaacgaaatggccaaggttgacgactctttcttccacagattggaagaatctttcttggttgaagaagacaagaagcacgaaagacatccaatcttcggtaacatcgttgacgaagttgcttaccacgaaaaataccctaccatctaccatttgagaaagaagttggtcgattccaccgacaaggctgatttgagattgatctatttggccttggctcacatgatcaagttcagaggtcacttcttgattgaaggtgacttgaacccagacaactctgacgtcgacaaattgttcatccaattggtccaaacctacaaccaattattcgaggaaaacccaattaacgcttctggtgttgatgctaaggccatcttatctgcccgtttgtccaagtctagacgtttggaaaacttgattgctcaattgcctggtgaaaagaaaaacggtttgttcggtaacttgatcgctttgtccttgggtttgaccccaaacttcaagtccaacttcgacttggctgaagatgccaagttgcaattgtccaaggacacctacgacgacgacttagacaacttgttggctcaaatcggtgaccaatacgccgacttgttcttggctgccaaaaacttatctgacgctatcttgttgtctgacatcttgagagttaacactgaaattaccaaggctccattgtctgcttctatgatcaaaagatacgacgaacaccaccaagatctgactttgttgaaggctttggttagacaacaattgccagaaaagtacaaggaaatcttcttcgaccaatccaaaaatggttacgccggttacattgacggtggtgcttctcaggaagaattctacaagttcatcaagccaattttggaaaagatggatggtactgaagaattattggttaagttgaacagagaagacttattgagaaagcaacgtaccttcgataacggttctatcccacaccaaatccacttgggtgaattgcacgccattttgagaagacaggaagatttctatccattcctaaaggacaacagagaaaagatcgaaaagatcttaactttcagaatcccatactacgtcggtccattggccagaggtaattctagattcgcttggatgaccagaaagtctgaagaaaccatcaccccatggaacttcgaagaagtcgtcgacaagggtgcttctgcccaatctttcatcgaaagaatgaccaactttgataagaacttgccaaacgagaaggtcttgccaaagcactctttgttgtacgaatacttcaccgtctacaacgaattaaccaaggttaaatacgttactgaaggtatgagaaagccagctttcctatccggtgaacaaaagaaggctattgttgacttgttgtttaagaccaacagaaaggtcactgttaagcaattgaaggaagactacttcaagaagattgaatgtttcgattccgtcgaaatctccggtgttgaagaccgtttcaatgcttctttgggcacctaccacgatttgttaaagatcatcaaggacaaggactttttagataacgaagaaaacgaagacatcttggaagatatcgttttgaccttgactcttttcgaggacagagaaatgattgaagagagattgaagacctacgctcacttgttcgacgataaagttatgaagcaactaaagagaagaagatacactggttggggtagattgtccagaaagttgattaacggtatcagagacaagcaatccggtaagactattttagactttttgaaatccgatggtttcgctaacagaaactttatgcaattgattcacgacgattctttgactttcaaggaagacattcaaaaagcccaagtctctggtcaaggtgattctttgcacgaacacatcgctaacttggctggttctccagctattaagaagggtatcttacaaaccgtcaaggtcgttgatgaattggtcaaagtcatgggtagacacaagccagaaaatattgtcatcgaaatggctagagaaaaccaaactactcaaaagggtcaaaagaactctagagaacgtatgaagagaattgaagaaggtatcaaggagttgggttctcaaattttgaaagaacacccagtcgaaaacactcaattacaaaacgaaaagctatacttgtactacttgcaaaacggtcgtgacatgtacgtcgaccaagaattggatatcaacagattgtctgactacgatgtcgatcatatcgtcccacaatcgttcttgaaggacgattccattgacaacaaagttttgactagatctgacaagaacagaggtaagtctgataacgttccatctgaagaagttgttaagaagatgaagaactactggagacaattgttgaatgctaagttgatcactcaaagaaagttcgacaacttgaccaaggctgaaagaggtggtttgtccgaattggacaaagccggtttcatcaagagacaattagtcgaaactagacaaatcaccaagcatgttgctcaaatcttggattccagaatgaacactaagtacgatgaaaacgacaaactaattagagaagttaaggtcatcactttgaagtctaagttggtttctgacttcagaaaggacttccaattttacaaggtcagagaaatcaacaactaccatcacgctcacgatgcctacttgaacgctgttgtcggtactgccttaatcaaaaagtacccaaagttggaatctgaattcgtttacggtgactacaaggtttacgatgttagaaagatgatcgccaagtctgaacaagaaattggtaaggccactgctaagtacttcttctactctaacatcatgaactttttcaagactgaaatcactttagctaacggtgaaattagaaagcgtccattgattgaaaccaatggtgaaactggtgaaattgtctgggacaagggtagagatttcgctaccgtcagaaaggttttgtctatgccacaagttaacatcgtcaagaagactgaagttcaaactggtggtttctctaaggaatccattttgccaaagagaaactctgacaagttgattgctagaaagaaggactgggatcctaagaagtacggtggtttcgactctccaactgttgcttactccgttttggtcgttgctaaggttgaaaagggtaagtctaagaagttgaagtctgttaaggaattgttgggtatcaccatcatggaaagatcctccttcgaaaagaacccaatcgactttttggaagctaagggttacaaggaagtcaagaaggatttgatcattaagttaccaaaatactccttgttcgaattggaaaacggtagaaagagaatgttggcctccgctggtgaactacaaaaaggtaacgaattggctttaccatctaagtacgttaacttcttgtacttggcttcccactacgaaaagttgaaaggttccccagaagacaacgaacaaaagcaattgtttgttgaacaacacaagcactacttggatgaaattattgaacaaatctccgaattctccaagagagtcattttggctgatgctaacttagataaggttttatccgcttacaacaagcacagagacaaaccaatcagagaacaagctgaaaacatcattcatttgttcactttaaccaacttgggtgctccagctgctttcaaatacttcgacactaccattgacagaaagagatacacttccaccaaagaagttttagatgctactttgattcaccaatctattaccggtttgtacgaaaccagaattgacttgtctcaattgggtggtgattccagagctgatccaaagaagaagagaaaggtgtaaaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttggcgctatcttaattactctggctgccaggcccgtgtagagggccgcaagaccttctgtacgccatatagtctctaagaacttgaacaagtttctagacctattgccgcctttcggatcgctattgttgcggccgcttgcccatcgaacgtacaagtactcctctgttctctccttcctttgcttt

SEQ ID NO: 12 - DNA, 5189 bp, Artificial Sequence
  Synthetic construct
aagcgacttccaatcgctttgcatatccagtaccacacccacaggcgttttaccgttcgtataatgtatgctatacgaagttatggtaccttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggacaagaaatactctattggtttggatatcgggaccaactccgtcggttgggctgtcatcaccgacgaatacaaggttccatccaagaaattcaaggtcttgggtaacactgacagacactctatcaagaagaatttgatcggtgctttgttgttcgactccggtgaaaccgctgaagctaccagattgaagcgtaccgctcgtcgtagatacactagacgtaaaaaccgtatttgttacttgcaagaaatcttttctaacgaaatggccaaggttgacgactctttcttccacagattggaagaatctttcttggttgaagaagacaagaagcacgaaagacatccaatcttcggtaacatcgttgacgaagttgcttaccacgaaaaataccctaccatctaccatttgagaaagaagttggtcgattccaccgacaaggctgatttgagattgatctatttggccttggctcacatgatcaagttcagaggtcacttcttgattgaaggtgacttgaacccagacaactctgacgtcgacaaattgttcatccaattggtccaaacctacaaccaattattcgaggaaaacccaattaacgcttctggtgttgatgctaaggccatcttatctgcccgtttgtccaagtctagacgtttggaaaacttgattgctcaattgcctggtgaaaagaaaaacggtttgttcggtaacttgatcgctttgtccttgggtttgaccccaaacttcaagtccaacttcgacttggctgaagatgccaagttgcaattgtccaaggacacctacgacgacgacttagacaacttgttggctcaaatcggtgaccaatacgccgacttgttcttggctgccaaaaacttatctgacgctatcttgttgtctgacatcttgagagttaacactgaaattaccaaggctccattgtctgcttctatgatcaaaagatacgacgaacaccaccaagatctgactttgttgaaggctttggttagacaacaattgccagaaaagtacaaggaaatcttcttcgaccaatccaaaaatggttacgccggttacattgacggtggtgcttctcaggaagaattctacaagttcatcaagccaattttggaaaagatggatggtactgaagaattattggttaagttgaacagagaagacttattgagaaagcaacgtaccttcgataacggttctatcccacaccaaatccacttgggtgaattgcacgccattttgagaagacaggaagatttctatccattcctaaaggacaacagagaaaagatcgaaaagatcttaactttcagaatcccatactacgtcggtccattggccagaggtaattctagattcgcttggatgaccagaaagtctgaagaaaccatcaccccatggaacttcgaagaagtcgtcgacaagggtgcttctgcccaatctttcatcgaaagaatgaccaactttgataagaacttgccaaacgagaaggtcttgccaaagcactctttgttgtacgaatacttcaccgtctacaacgaattaaccaaggttaaatacgttactgaaggtatgagaaagccagctttcctatccggtgaacaaaagaaggctattgttgacttgttgtttaagaccaacagaaaggtcactgttaagcaattgaaggaagactacttcaagaagattgaatgtttcgattccgtcgaaatctccggtgttgaagaccgtttcaatgcttctttgggcacctaccacgatttgttaaagatcatcaaggacaaggactttttagataacgaagaaaacgaagacatcttggaagatatcgttttgaccttgactcttttcgaggacagagaaatgattgaagagagattgaagacctacgctcacttgttcgacgataaagttatgaagcaactaaagagaagaagatacactggttggggtagattgtccagaaagttgattaacggtatcagagacaagcaatccggtaagactattttagactttttgaaatccgatggtttcgctaacagaaactttatgcaattgattcacgacgattctttgactttcaaggaagacattcaaaaagcccaagtctctggtcaaggtgattctttgcacgaacacatcgctaacttggctggttctccagctattaagaagggtatcttacaaaccgtcaaggtcgttgatgaattggtcaaagtcatgggtagacacaagccagaaaatattgtcatcgaaatggctagagaaaaccaaactactcaaaagggtcaaaagaactctagagaacgtatgaagagaattgaagaaggtatcaaggagttgggttctcaaattttgaaagaacacccagtcgaaaacactcaattacaaaacgaaaagctatacttgtactacttgcaaaacggtcgtgacatgtacgtcgaccaagaattggatatcaacagattgtctgactacgatgtcgatcatatcgtcccacaatcgttcttgaaggacgattccattgacaacaaagttttgactagatctgacaagaacagaggtaagtctgataacgttccatctgaagaagttgttaagaagatgaagaactactggagacaattgttgaatgctaagttgatcactcaaagaaagttcgacaacttgaccaaggctgaaagaggtggtttgtccgaattggacaaagccggtttcatcaagagacaattagtcgaaactagacaaatcaccaagcatgttgctcaaatcttggattccagaatgaacactaagtacgatgaaaacgacaaactaattagagaagttaaggtcatcactttgaagtctaagttggtttctgacttcagaaaggacttccaattttacaaggtcagagaaatcaacaactaccatcacgctcacgatgcctacttgaacgctgttgtcggtactgccttaatcaaaaagtacccaaagttggaatctgaattcgtttacggtgactacaaggtttacgatgttagaaagatgatcgccaagtctgaacaagaaattggtaaggccactgctaagtacttcttctactctaacatcatgaactttttcaagactgaaatcactttagctaacggtgaaattagaaagcgtccattgattgaaaccaatggtgaaactggtgaaattgtctgggacaagggtagagatttcgctaccgtcagaaaggttttgtctatgccacaagttaacatcgtcaagaagactgaagttcaaactggtggtttctctaaggaatccattttgccaaagagaaactctgacaagttgattgctagaaagaaggactgggatcctaagaagtacggtggtttcgactctccaactgttgcttactccgttttggtcgttgctaaggttgaaaagggtaagtctaagaagttgaagtctgttaaggaattgttgggtatcaccatcatggaaagatcctccttcgaaaagaacccaatcgactttttggaagctaagggttacaaggaagtcaagaaggatttgatcattaagttaccaaaatactccttgttcgaattggaaaacggtagaaagagaatgttggcctccgctggtgaactacaaaaaggtaacgaattggctttaccatctaagtacgttaacttcttgtacttggcttcccactacgaaaagttgaaaggttccccagaagacaacgaacaaaagcaattgtttgttgaacaacacaagcactacttggatgaaattattgaacaaatctccgaattctccaagagagtcattttggctgatgctaacttagataaggttttatccgcttacaacaagcacagagacaaaccaatcagagaacaagctgaaaacatcattcatttgttcactttaaccaacttgggtgctccagctgctttcaaatacttcgacactaccattgacagaaagagatacacttccaccaaagaagttttagatgctactttgattcaccaatctattaccggtttgtacgaaaccagaattgacttgtctcaattgggtggtgattccagagctgatccaaagaagaagagaaaggtgtaaaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttggcgctatcttaattactctggctgccaggcccgtgtagagggccgcaagaccttctgtacgccatatagtctctaagaacttgaacaagtttctagacctattgccgcctttcggatcgctattgttgcggccgcttgcccatcgaacgtacaagtactcctctgttctctccttcctttgcttt

SEQ ID NO: 13 - DNA, 1600 bp, Artificial Sequence
  Synthetic construct
gcggccgccagctgaagcttcgtacgctgcaggtcgacgaattctaccgttcgtataatgtatgctatacgaagttatagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggtagaattcgatatcagatccactagtggcctatgcggccgc

SEQ ID NO: 14 - DNA, 1363 bp, Artificial Sequence
  Synthetic construct
gcggccgccagctgaagcttcgtacgctgcaggtcgacgaattctaccgttcgtataatgtatgctatacgaagttatagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgacggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggtagaattcgatatcagatccactagtggcctatgcggccgc

SEQ ID NO: 15 - DNA, 486 bp, Artificial Sequence
  Synthetic construct
ctgcagcccgggggatccactagttctagagcggccgccaccgcccgcggtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcacttgaagattctttagtgtgttttagagctagaaatagcaagttaaaataaggctagtccgttatcaacttgaaaaagtggcaccgagtcggtggtgctttttttgttttttatgtctccgcggcaattaaccctcactaaagggaacaaaagctggagctccacc

SEQ ID NO: 16 - DNA, 108 bp, Artificial Sequence
  Synthetic construct
ctagcttaaaaatgtgatgtgctaacgattgagattgagcatgttgatgttcatacactaaagaatcttcaagtaaaacatcccaaattaaaaatttacccttctcca

SEQ ID NO: 17 - DNA, 108 bp, Artificial Sequence
  Synthetic construct
tggagaagggtaaatttttaatttgggatgttttacttgaagattctttagtgtatgaacatcaacatgctcaatctcaatcgttagcacatcacatttttaagctag

SEQ ID NO: 18 - DNA, 20 bp, Artificial Sequence
  Synthetic construct
aggcagcaaacaggctcaac

SEQ ID NO: 19 - DNA, 20 bp, Artificial Sequence
  Synthetic construct
cctcgacttcaagacgaatg

SEQ ID NO: 20 - DNA, 79 bp, Artificial Sequence
  Synthetic construct
gctatacgaacggtagaattcgatatcagatccactagtggcctatgcggccgccaccgcggtctttgaaaagataatg

SEQ ID NO: 21 - DNA, 79 bp, Artificial Sequence
  Synthetic construct
ccatgattacgccaagcgcgcaattaaccctcactaaagggaacaaaagctggagctccaccgcggagacataaaaaac

SEQ ID NO: 22 - DNA, 5776 bp, Artificial Sequence
  Synthetic construct
taccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcatccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaacagcgacaaagattttgttatcggcctaagggtactgttgacattgcgaacagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggg

SEQ ID NO: 23 - DNA, 1716 bp, Artificial Sequence
  Synthetic construct
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaagtaa

SEQ ID NO: 24 - DNA, 10406 bp, Artificial Sequence
  Synthetic construct
gctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaccaatatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgacttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatagcgtgaggtaccgttcgtatagcatacattatacgaagttatgagctcgttttcgacactggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactgatttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagccaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccattgttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgcacttttgcatgcaggtttttccgtcttctctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcccgcggtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcaaatttatcaacagtgtatagttttagagctagaaatagcaagttaaaataaggctagtccgttatcaacttgaaaaagtggcaccgagtcggtggtgctttttttgttttttatgtctccgcgggttttagagctagaaatagcaagttaaaataaggctagtccgttatcaacttgaaaaagtggcaccgagtcggtggtgctttttttgttttttatgtctgaagacacaccgggtctcggtggatatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagtgaccgcctcgtttctttttcttcgtcgaaaaaggcaataaaaatttttatcacgtttctttttcttgaaaatttttttttttgatttttttctctttcgatgacctcccattgatatttaagttaataaacggacttcaatttctcaagtttcagtttcatttttcttgttctattacaactttttttacttcttgctcattagaaagaaagcatagcaatctaatctaagtttaagccaacagagacctctagaactagtggatcccccgggaaaaatggataagaaatactcaataggacttgatatcggtacgaacagcgttggatgggccgttattaccgatgagtacaaagtcccttccaaaaagtttaaggttttaggcaatactgatagacatagcataaagaaaaatctaattggtgccttgcttttcgattctggagaaacagcggaagctacaagactcaaaagaacagcacgacgtagatacactagaagaaagaacagaatttgttacttacaagaaatcttcagcaatgaaatggcaaaagttgatgactcatttttccacaggttagaagagtcctttttggtcgaagaagataagaaacatgaacgacacccaatattcggaaacatcgtagacgaagtggcttaccacgagaaataccctaccatctatcacttgagaaaaaagttagtagattctacagataaagctgatttaagattaatctacttagccctcgcgcatatgattaagtttagaggtcattttctaatcgagggtgacctcaaccctgataacagtgatgtagataaacttttcatccaactcgtccaaacttataaccaattgtttgaggaaaatcctattaacgcatctggtgtcgacgctaaagcaattttgtcagcaagactatccaaatcgcgtagactagaaaatttaatcgcccaattgccaggtgagaaaaagaacggtcttttcggaaacttaatcgctttatcattgggcttgacaccaaacttcaaatctaatttcgacctagctgaagatgccaagttgcaactcagtaaagacacatatgacgatgacctagacaatctattagcccaaattggtgatcaatatgcagatctgtttctggctgccaaaaatcttagtgacgctattcttctgtccgacatattgagagtaaatactgaaatcacaaaagcaccactttcagcttcaatgattaagagatacgatgaacatcaccaggacctgactttgttgaaggctctggtaagacaacaattgcctgaaaagtacaaagaaatctttttcgatcaaagtaagaatggatacgccggatacatcgatggtggcgcttctcaagaagagttttacaagtttatcaagcctatcttagagaagatggatggcacggaagaattgttggttaagctcaatagagaggatcttctccgaaaacagagaacttttgataatgggtccattccacatcaaattcacctgggtgaattgcatgctatcttaagacgtcaggaagatttctatcctttcttgaaagataatagagagaagatcgaaaagattttgacctttagaattccttattacgtgggcccattggccagagggaactcaagattcgcttggatgactaggaaatcagaagaaactattacgccttggaattttgaagaagtcgttgacaaaggggcatccgctcaatccttcatagaacgtatgacaaatttcgacaaaaacctaccaaatgaaaaagttcttccaaagcattctttgttatacgaatactttactgtatacaatgaactaacaaaagttaaatatgttaccgaggggatgagaaaaccagcttttctttcaggcgagcagaaaaaggcaattgtcgacttgttgtttaagacaaatagaaaagtcacagttaagcaacttaaagaagattacttcaaaaagatcgagtgctttgattctgttgagatctctggtgtagaagatagatttaacgcatcactgggtacctaccatgatttactaaagatcataaaagataaagactttttggataacgaagaaaacgaagatatacttgaagatatcgtcctaacacttacgttatttgaagatagagagatgattgaagaaaggttaaagacctacgcccatctctttgacgacaaagtaatgaaacaacttaagcgtcgaagatacactggatggggaagattatccagaaaactaatcaacggtataagagataaacagtctggtaaaactatcttagatttcctaaaatctgatggctttgcgaatagaaatttcatgcaattgattcatgacgactcactgacattcaaagaagatatccaaaaggcgcaagtatccgggcaaggggacagtttacatgaacatatagccaatttagctggttcaccagctatcaaaaagggtattttgcagacagttaaagttgtggatgagttggttaaggttatgggcagacacaaacctgagaatattgtaatagaaatggcaagagaaaatcaaactacccaaaagggacaaaagaactctagggaaagaatgaaaagaattgaggaaggcattaaagaattgggttctcaaatactgaaagaacacccagtagaaaatacacaattacaaaatgagaaattgtacttgtactatttacaaaacggtagagacatgtatgttgatcaagaattggacatcaacagactgagtgattatgatgtggatcacatcgtacctcagtcattcttaaaagatgattctattgataacaaagtccttacacgctctgataagaacaggggtaaaagcgataacgttccatcagaagaagtggtgaagaaaatgaaaaactactggagacagttgttaaatgcaaaattgattactcaacgtaagtttgataatctaactaaggctgagaggggcggattaagtgaactcgataaggctggcttcattaagagacaacttgtggaaacaagacaaatcactaaacacgtggcacaaatcttagattcaagaatgaatactaagtatgacgaaaatgacaagctgattagagaagttaaagtgattacactaaaaagcaaactagtttctgactttaggaaagattttcaattctacaaagttagagagattaacaattaccaccatgcccatgatgcatacttaaatgctgtcgtcggcactgcattgataaagaaatacccaaagctcgagtctgagtttgtatacggtgactataaagtctatgacgtgagaaagatgattgctaagtctgaacaagaaatcggtaaggctacagccaagtatttcttttactcaaacataatgaacttctttaagactgaaatcactctggccaatggagaaattagaaaaagaccattgatagagactaatggtgaaaccggagaaattgtttgggacaagggaagagattttgccacagttagaaaggttctgtctatgcctcaggttaacatcgttaagaaaaccgaagtacagactggtgggttctctaaagaatcaatcctgccaaaaagaaacagtgataaactaatagcccgtaagaaagactgggacccaaagaaatacgggggctttgatagtccaactgtggcgtattccgtcttagttgttgcaaaggttgaaaagggtaaatctaagaaactaaaatctgtaaaagaattgttaggtatcacgatcatggaaagatcatcattcgagaaaaatccaattgactttctagaggcgaaaggatacaaagaagtaaagaaagacctcatcatcaaattgcccaagtattctctgttcgaattagagaatgggagaaaacgtatgcttgcttcagctggtgagctacaaaagggtaatgaattggcactcccatccaaatatgtgaacttcctctatctggctagccattacgagaagttgaaaggttctccagaggacaatgaacaaaaacaactttttgtcgaacaacataaacattacttggatgagatcatcgaacagatttctgaattttcgaagagagtgattttagctgacgcgaatctggataaagtgttgtctgcatacaataaacatagagataaacctattagagaacaagcagaaaacataatccacttgtttaccttaacaaatcttggcgctccagccgcttttaagtacttcgatacaacaattgacagaaagcgttacacttctactaaagaagtccttgatgctaccctaattcatcagtccatcacaggtttatacgaaacaagaatagatttatcacaacttggcggagattctagagctgatccaaagaagaaaagaaaggtttaatctcttctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacacctgcgcatccccgagcggtatca

SEQ ID NO: 25 - DNA, 1626 bp, Artificial Sequence
  Synthetic construct
atgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataa

SEQ ID NO: 26 - DNA, 108 bp, Artificial Sequence
  Synthetic construct
tgaaagattctttccaaacttccatcgttttaggtatagtcacattcgcatccactttcgtggcattatacactgttgataaatttggtcgtcgtaagtgtctattgg

SEQ ID NO: 27 - DNA, 108 bp, Artificial Sequence
  Synthetic construct
ccaatagacacttacgacgaccaaatttatcaacagtgtataatgccacgaaagtggatgcgaatgtgactatacctaaaacgatggaagtttggaaagaatctttca

SEQ ID NO: 28 - DNA, 20 bp, Artificial Sequence
  Synthetic construct
ttagccggtaacgcttcttg

SEQ ID NO: 29 - DNA, 20 bp, Artificial Sequence
  Synthetic construct
tcggcaacaataacgtaggc

SEQ ID NO: 30 - DNA, 486 bp, Artificial Sequence
  Synthetic construct
ctgcagcccgggggatccactagttctagagcggccgccaccgcccgcggtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctccgcggcaattaaccctcactaaagggaacaaaagctggagctccacc

SEQ ID NO: 31 - DNA, 19 bp, Artificial Sequence
  Synthetic construct
cggcattattgtgtatggc

SEQ ID NO: 32 - DNA, 73 bp, Artificial Sequence
  Synthetic construct
aaacgcctgtgggtgtggtactggatatgcaaagcgattggaagtcgcttggagttacgcccgtataccagag

SEQ ID NO: 33 - DNA, 90 bp, Artificial Sequence
  Synthetic construct
agaaagcctgtatgcgaagccacaatcctttccaacagaccatactaagtattttattttactttttttagaatgacctgttcccgacac

SEQ ID NO: 34 - DNA, 24 bp, Artificial Sequence
  Synthetic construct
cacaagcttattcttccaaaaatc

SEQ ID NO: 35 - DNA, 23 bp, Artificial Sequence
  Synthetic construct
cactatagcaatctggctatatg

SEQ ID NO: 36 - DNA, 70 bp, Artificial Sequence
  Synthetic construct
aaacgcctgtgggtgtggtactggatatgcaaagcgattggaagtcgcttgactcctctgccgtcattcc

SEQ ID NO: 37 - DNA, 72 bp, Artificial Sequence
  Synthetic construct
agaaagcctgtatgcgaagccacaatcctttccaacagaccatactaagtaagcgttgaagtttcctctttg

SEQ ID NO: 38 - DNA, 20 bp, Artificial Sequence
  Synthetic construct
tgtcaactggagagctatcg

SEQ ID NO: 39 - DNA, 22 bp, Artificial Sequence
  Synthetic construct
atttccaaacaacaggcctgtg

SEQ ID NO: 40 - DNA, 71 bp, Artificial Sequence
  Synthetic construct
aaacgcctgtgggtgtggtactggatatgcaaagcgattggaagtcgcttcctgctttactcttacgtcag

SEQ ID NO: 41 - DNA, 70 bp, Artificial Sequence
  Synthetic construct
agaaagcctgtatgcgaagccacaatcctttccaacagaccatactaagtggtggaggcactaatgacac

SEQ ID NO: 42 - DNA, 21 bp, Artificial Sequence
  Synthetic construct
cactatggccaactcttaccc

SEQ ID NO: 43 - DNA, 22 bp, Artificial Sequence
  Synthetic construct
actttgccttctttgtcacagc

SEQ ID NO: 44 - DNA, 71 bp, Artificial Sequence
  Synthetic construct
aaacgcctgtgggtgtggtactggatatgcaaagcgattggaagtcgcttctcctctagttgcggattacc

SEQ ID NO: 45 - DNA, 71 bp, Artificial Sequence
  Synthetic construct
agaaagcctgtatgcgaagccacaatcctttccaacagaccatactaagtctgttgtgacagcatcttgtc

SEQ ID NO: 46 - DNA, 22 bp, Artificial Sequence
  Synthetic construct
cctagcagtagttgtaatgtgg

SEQ ID NO: 47 - DNA, 71 bp, Artificial Sequence
  Synthetic construct
aagcgacttccaatcgctttgcatatccagtaccacacccacaggcgtttgtgcgacacctaactacatag

SEQ ID NO: 48 - DNA, 71 bp, Artificial Sequence
  Synthetic construct
acttagtatggtctgttggaaaggattgtggcttcgcatacaggctttctgaggggaggaaatgagaaatg

SEQ ID NO: 49 - DNA, 1720 bp, Artificial Sequence
  Synthetic construct
acgctttccggcatcttccagaccacagtatatccatccgcctcctgttggtgcgacacctaactacatagtgtttaaagattacggatatttaacttacttagaataatgccatttttttgagttataataatcctacgttagtgtgagcgggatttaaactgtgaggaccttaatacattcagacacttctgcggtatcaccctacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaatggtaagtaagggtgaagaagacaatatggcgatcattaaggaattcatgcgtttcaaagtacacatggagggaagcgtgaacggacatgaatttgaaatcgaaggggaaggcgaaggtagaccatacgaaggaacccagaccgcaaagcttaaagttaccaaaggcgggccactaccatttgcatgggatatcttgagccctcagtttatgtatggcagtaaggcctacgttaaacacccagctgatattcccgactatttgaaattgtcttttccagaaggattcaaatgggaaagagtaatgaatttcgaggacggcggagttgttactgttactcaagattcaagtttgcaagacggtgaatttatttacaaggtcaaattaagagggactaatttccctagtgatggtcccgtcatgcaaaagaagactatgggttgggaagcctcatctgaacgtatgtatccagaagatggcgcgcttaagggggaaattaaacaaagattgaagttaaaagacggtggtcactacgacgcggaagttaagaccacttataaagctaaaaagcccgttcagttacctggtgcatataacgtaaacattaaattggatatcacttcacataatgaagattacactattgtggaacaatatgaaagagctgaaggtaggcactcaacgggtggaatggacgaattgtacaaataaaagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcccctcagaaagcctgtatgcgaagccacaatcctttccaacagaccatactaagt

SEQ ID NO: 50 - DNA, 11009 bp, Artificial Sequence
  Synthetic construct
ttttccgtcttctctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctagacataaaaaacaaaaaaagcaccaccgactcggtgccactttttcaagttgataacggactagccttattttaacttgctatttctagctctaaaacacactaaagaatcttcaagtgatcatttatctttcactgcggagaagtttcgaacgccgaaacatgcgcaccaactttcacttctacagcgtttgaccaaaatcttttgaacagaacattgtagggtgtgaaaaaatgcgcacctttaccgctagcccaagagggcactacaaaatctagagttgtacttcaaacgtacatgtaatcaccttgtatatactcgaaagaaaacatcaagtttctgtataaatatgagtgaaagcataatcatacattatcttttcaaagagaagacacaccgggtctcggtggatttttctttttttgcggtcacccccatgtggcggggaggcagaggagtaggtagagcaacgaatcctactatttatccaaattagtctaggaactctttttctagattttttagatttgagggcaagcgctgttaacgactcagaaatgtaagcactacggagtagaacgagaaatccgccataggtggaaatcctagcaaaatcttgcttaccctagctagcctcaggtaagctagccttagcctgtcaaatttttttcaaaatttggtaagtttctactagcaaagcaaacacggttcaacaaaccgaaaactccactcattatacgtggaaaccgaaacaaaaaaacaaaaaccaaaatactcgccaatgagaaagttgctgcgtttctactttcgaggaagaggaactgagaggattgactacgaaaggggcaaaaacgagtcgtattctcccattattgtctgctaccacgcggtctagtagaataagcaaccagtcaacgctaagacaggtaatcaaaataccagtctgctggctacgggctagtttttacctcttttagaacccactgtaaaagtccgttgtaaagcccgttctcactgttggcgtttttttttttttggtttagtttcttatttttcatttttttctttcatgaccaaaaacaaacaaatctcgcgatttgtactgcggccactggggcgtggccaaaaaaatgacaaatttagaaaccttagtttctgatttttcctgttatgaggagatatgataaaaaatattactgctttattgttttttttttatctactgaaatagagaaacttacccaaggaggaggcaaaaaaaagagtatatatacagcaggtaccattcagattttaatatattcttttctcttcttctacactattattataataattttactatattcatttttagcttaaaacctcatagaatattattcttcagtcactcgcttaaatacttatcaaagccaacagagacctctagaactagtggatcccccgggaaaaatggataagaaatactcaataggacttgatatcggtacgaacagcgttggatgggccgttattaccgatgagtacaaagtcccttccaaaaagtttaaggttttaggcaatactgatagacatagcataaagaaaaatctaattggtgccttgcttttcgattctggagaaacagcggaagctacaagactcaaaagaacagcacgacgtagatacactagaagaaagaacagaatttgttacttacaagaaatcttcagcaatgaaatggcaaaagttgatgactcatttttccacaggttagaagagtcctttttggtcgaagaagataagaaacatgaacgacacccaatattcggaaacatcgtagacgaagtggcttaccacgagaaataccctaccatctatcacttgagaaaaaagttagtagattctacagataaagctgatttaagattaatctacttagccctcgcgcatatgattaagtttagaggtcattttctaatcgagggtgacctcaaccctgataacagtgatgtagataaacttttcatccaactcgtccaaacttataaccaattgtttgaggaaaatcctattaacgcatctggtgtcgacgctaaagcaattttgtcagcaagactatccaaatcgcgtagactagaaaatttaatcgcccaattgccaggtgagaaaaagaacggtcttttcggaaacttaatcgctttatcattgggcttgacaccaaacttcaaatctaatttcgacctagctgaagatgccaagttgcaactcagtaaagacacatatgacgatgacctagacaatctattagcccaaattggtgatcaatatgcagatctgtttctggctgccaaaaatcttagtgacgctattcttctgtccgacatattgagagtaaatactgaaatcacaaaagcaccactttcagcttcaatgattaagagatacgatgaacatcaccaggacctgactttgttgaaggctctggtaagacaacaattgcctgaaaagtacaaagaaatctttttcgatcaaagtaagaatggatacgccggatacatcgatggtggcgcttctcaagaagagttttacaagtttatcaagcctatcttagagaagatggatggcacggaagaattgttggttaagctcaatagagaggatcttctccgaaaacagagaacttttgataatgggtccattccacatcaaattcacctgggtgaattgcatgctatcttaagacgtcaggaagatttctatcctttcttgaaagataatagagagaagatcgaaaagattttgacctttagaattccttattacgtgggcccattggccagagggaactcaagattcgcttggatgactaggaaatcagaagaaactattacgccttggaattttgaagaagtcgttgacaaaggggcatccgctcaatccttcatagaacgtatgacaaatttcgacaaaaacctaccaaatgaaaaagttcttccaaagcattctttgttatacgaatactttactgtatacaatgaactaacaaaagttaaatatgttaccgaggggatgagaaaaccagcttttctttcaggcgagcagaaaaaggcaattgtcgacttgttgtttaagacaaatagaaaagtcacagttaagcaacttaaagaagattacttcaaaaagatcgagtgctttgattctgttgagatctctggtgtagaagatagatttaacgcatcactgggtacctaccatgatttactaaagatcataaaagataaagactttttggataacgaagaaaacgaagatatacttgaagatatcgtcctaacacttacgttatttgaagatagagagatgattgaagaaaggttaaagacctacgcccatctctttgacgacaaagtaatgaaacaacttaagcgtcgaagatacactggatggggaagattatccagaaaactaatcaacggtataagagataaacagtctggtaaaactatcttagatttcctaaaatctgatggctttgcgaatagaaatttcatgcaattgattcatgacgactcactgacattcaaagaagatatccaaaaggcgcaagtatccgggcaaggggacagtttacatgaacatatagccaatttagctggttcaccagctatcaaaaagggtattttgcagacagttaaagttgtggatgagttggttaaggttatgggcagacacaaacctgagaatattgtaatagaaatggcaagagaaaatcaaactacccaaaagggacaaaagaactctagggaaagaatgaaaagaattgaggaaggcattaaagaattgggttctcaaatactgaaagaacacccagtagaaaatacacaattacaaaatgagaaattgtacttgtactatttacaaaacggtagagacatgtatgttgatcaagaattggacatcaacagactgagtgattatgatgtggatcacatcgtacctcagtcattcttaaaagatgattctattgataacaaagtccttacacgctctgataagaacaggggtaaaagcgataacgttccatcagaagaagtggtgaagaaaatgaaaaactactggagacagttgttaaatgcaaaattgattactcaacgtaagtttgataatctaactaaggctgagaggggcggattaagtgaactcgataaggctggcttcattaagagacaacttgtggaaacaagacaaatcactaaacacgtggcacaaatcttagattcaagaatgaatactaagtatgacgaaaatgacaagctgattagagaagttaaagtgattacactaaaaagcaaactagtttctgactttaggaaagattttcaattctacaaagttagagagattaacaattaccaccatgcccatgatgcatacttaaatgctgtcgtcggcactgcattgataaagaaatacccaaagctcgagtctgagtttgtatacggtgactataaagtctatgacgtgagaaagatgattgctaagtctgaacaagaaatcggtaaggctacagccaagtatttcttttactcaaacataatgaacttctttaagactgaaatcactctggccaatggagaaattagaaaaagaccattgatagagactaatggtgaaaccggagaaattgtttgggacaagggaagagattttgccacagttagaaaggttctgtctatgcctcaggttaacatcgttaagaaaaccgaagtacagactggtgggttctctaaagaatcaatcctgccaaaaagaaacagtgataaactaatagcccgtaagaaagactgggacccaaagaaatacgggggctttgatagtccaactgtggcgtattccgtcttagttgttgcaaaggttgaaaagggtaaatctaagaaactaaaatctgtaaaagaattgttaggtatcacgatcatggaaagatcatcattcgagaaaaatccaattgactttctagaggcgaaaggatacaaagaagtaaagaaagacctcatcatcaaattgcccaagtattctctgttcgaattagagaatgggagaaaacgtatgcttgcttcagctggtgagctacaaaagggtaatgaattggcactcccatccaaatatgtgaacttcctctatctggctagccattacgagaagttgaaaggttctccagaggacaatgaacaaaaacaactttttgtcgaacaacataaacattacttggatgagatcatcgaacagatttctgaattttcgaagagagtgattttagctgacgcgaatctggataaagtgttgtctgcatacaataaacatagagataaacctattagagaacaagcagaaaacataatccacttgtttaccttaacaaatcttggcgctccagccgcttttaagtacttcgatacaacaattgacagaaagcgttacacttctactaaagaagtccttgatgctaccctaattcatcagtccatcacaggtttatacgaaacaagaatagatttatcacaacttggcggagattctagagctgatccaaagaagaaaagaaaggtttaatctcttctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacacctgcgcatccccgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaccaatatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgacttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatagcgtgaggtaccgttcgtatagcatacattatacgaagttatgagctcgttttcgacactggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactgatttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagccaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccattgttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgcacttttgcatgcaggt

SEQ ID NO: 51 - DNA, 1726 bp, Artificial Sequence
  Synthetic construct
aagcgacttccaatcgctttgcatatccagtaccacacccacaggcgtttgtgcaacatatatacacaattacagtaacaataacaagaggacagatactaccaaaatgtgtggggaagcgggtaagctgccacagcaattaatgcacaacatttaacctacattcttccttatcggatcctcaaaacccttaaaaacatatgcctcaccctaacatattttccaattaaccctcaatatttctctgtcacccggcctctattttccattttcttctttacccgccacgcgtttttttctttcaaatttttttcttctttcttctttttcttccacgtcctcttgcataaataaataaaccgttttgaaaccaaactcgcctctctctctcctttttgaaatatttttgggtttgtttgatcctttccttcccaatctctcttgtttaatatatattcatttatatcacgctctctttttatcttcctttttttcctctctcttgtattcttccttcccctttctactcaaaccaagaagaaaaagaaaaggtcaatctttgttaaagaataggatcttctactacatcagcttttagatttttcacgcttactgcttttttcttcccaagatcgaaaatttactgaattaacaatgtctaaaggtgaagaattattcactggtgttgtcccaattttggttgaattagatggtgatgttaatggtcacaaattttctgtctccggtgaaggtgaaggtgatgctacttacggtaaattgaccttaaaattgatttgtactactggtaaattgccagttccatggccaaccttagtcactactttaggttatggtttgcaatgttttgctagatacccagatcatatgaaacaacatgactttttcaagtctgccatgccagaaggttatgttcaagaaagaactatttttttcaaagatgacggtaactacaagaccagagctgaagtcaagtttgaaggtgataccttagttaatagaatcgaattaaaaggtattgattttaaagaagatggtaacattttaggtcacaaattggaatacaactataactctcacaatgtttacatcactgctgacaaacaaaagaatggtatcaaagctaacttcaaaattagacacaacattgaagatggtggtgttcaattagctgaccattatcaacaaaatactccaattggtgatggtccagtcttgttaccagacaaccattacttatcctatcaatctgccttatccaaagatccaaacgaaaagagagatcacatggtcttgttagaatttgttactgctgctggtattacccatggtatggatgaattgtacaaataaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacctcttgcccatcgaacgtacaagtactcctctgttctctccttcctttgcttt

SEQ ID NO: 52 - DNA, 73 bp, Artificial Sequence
  Synthetic construct
aagcgacttccaatcgctttgcatatccagtaccacacccacaggcgtttgtgcaacatatatacacaattac

SEQ ID NO: 53 - DNA, 69 bp, Artificial Sequence
  Synthetic construct
acttagtatggtctgttggaaaggattgtggcttcgcatacaggctttctgaggttgtcctctgaggac

SEQ ID NO: 54 - DNA, 30 bp, Artificial Sequence
  Synthetic construct
tctttgaaaagataatgtatgattatgctt

SEQ ID NO: 55 - skipped

SEQ ID NO: 56 - DNA, 20 bp, Artificial Sequence
  Synthetic construct
tgccaagttttgcagcaggg

SEQ ID NO: 57 - DNA, 20 bp, Artificial Sequence
  Synthetic construct
ggggcgccatgcctatccgg

SEQ ID NO: 58 - DNA, 20 bp, Artificial Sequence
  Synthetic construct
ctgcaagtaacgaaagtccc

SEQ ID NO: 59 - DNA, 20 bp, Artificial Sequence
  Synthetic construct
tattctgcaggcgctcgcgc

SEQ ID NO: 60 - DNA, 20 bp, Artificial Sequence
  Synthetic construct
attaataagatcgtcagctt

SEQ ID NO: 61 - DNA, 20 bp, Artificial Sequence
  Synthetic construct
ctgaaagattctgctgtctc

SEQ ID NO: 62 - DNA, 496 bp, Artificial Sequence
  Synthetic construct
tctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcacttgaagattctttagtgtgttttagagctagaaatagcaagttaaaataaggctagtccgttatcaacttgaaaaagtggcaccgagtcggtggtgctttttttgttttttatgtctctagcttaaaaatgtgatgtgctaacgattgagattgagcatgttgatgttcatacactaaagaatcttcaagtaaaacatcccaaattaaaaatttacccttctcca

SEQ ID NO: 63 - DNA, 30 bp, Artificial Sequence
  Synthetic construct
tggagaagggtaaatttttaatttgggatg

SEQ ID NO: 64 - DNA, 519 bp, Artificial Sequence
  Synthetic contruct
tctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcacttgaagattctttagtgtgttttagagctagaaatagcaagttaaaataaggctagtccgttatcaacttgaaaaagtggcaccgagtcggtggtgctttttttgttttttatgtctcctacactaaagaatcttcaagtctagcttaaaaatgtgatgtgctaacgattgagattgagcatgttgatgttcatacactaaagaatcttcaagtaaaacatcccaaattaaaaatttacccttctcca

SEQ ID NO: 65 - DNA, 388 bp, Artificial Sequence
  Synthetic construct
agacataaaaaacaaaaaaagcaccaccgactcggtgccactttttcaagttgataacggactagccttattttaacttgctatttctagctctaaaacacactaaagaatcttcaagtgatcatttatctttcactgcggagaagtttcgaacgccgaaacatgcgcaccaactttcacttctacagcgtttgaccaaaatcttttgaacagaacattgtagggtgtgaaaaaatgcgcacctttaccgctagcccaagagggcactacaaaatctagagttgtacttcaaacgtacatgtaatcaccttgtatatactcgaaagaaaacatcaagtttctgtataaatatgagtgaaagcataatcatacattatcttttcaaaga

SEQ ID NO: 66 - DNA, 388 bp, Artificial Sequence
  Synthetic construct
tctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtct

SEQ ID NO: 67 - DNA, 20 bp, Artificial Sequence
  Synthetic construct
acttgaagattctttagtgt

SEQ ID NO: 68 - DNA, 20 bp, Artificial
  Synthetic construct
tattagaaccagggaggtcc

SEQ ID NO: 69-124 - skipped (56 entries)

SEQ ID NO: 125 - DNA, 20 bp, Artificial Sequence
  PCR primer
ccataaggagtagcgcttgg

SEQ ID NO: 126 - DNA, 21 bp, Artificial Sequence
  PCR primer
tgcgattcgagatccattagg

SEQ ID NO: 127 - DNA, 21 bp, Artificial Sequence
  PCR primer
gatatctcttgagtgctggtc

SEQ ID NO: 128 - DNA, 21 bp, Artificial Sequence
  PCR primer
gtggttctgctgcactaagtg

SEQ ID NO: 129 - DNA, 21 bp, Artificial Sequence
  PCR primer
ggtcggtattggtggttgttg

SEQ ID NO: 130 - DNA, 21 bp, Artificial Sequence
  PCR primer
actttctgatcaggaagaggc

SEQ ID NO: 131 - DNA, 21 bp, Artificial Sequence
  PCR primer
tagtgggttcatactgctgtg

SEQ ID NO: 132 - DNA, 20 bp, Artificial Sequence
  PCR primer
accagatcgatcctcagctg

SEQ ID NO: 133 - DNA, 21 bp, Artificial Sequence
  PCR primer
gtgataccgcagaagtgtctg

SEQ ID NO: 134 - DNA, 20 bp, Artificial Sequence
  PCR primer
cgctcttttggtcacccatg

SEQ ID NO: 135 - DNA, 11742 bp, Artificial Sequence
  Synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaacgacattactatatatataatataggaagcatttaatagacagcatcgtaatatatgtgtactttgcagttatgacgccagatggcagtagtggaagatattctttattgaaaaatagcttgtcaccttacgtacaatcttgatccggagcttttctttttttgccgattaagaattaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccttttctttttttgcggtcacccccatgtggcggggaggcagaggagtaggtagagcaacgaatcctactatttatccaaattagtctaggaactctttttctagattttttagatttgagggcaagcgctgttaacgactcagaaatgtaagcactacggagtagaacgagaaatccgccataggtggaaatcctagcaaaatcttgcttaccctagctagcctcaggtaagctagccttagcctgtcaaatttttttcaaaatttggtaagtttctactagcaaagcaaacacggttcaacaaaccgaaaactccactcattatacgtggaaaccgaaacaaaaaaacaaaaaccaaaatactcgccaatgagaaagttgctgcgtttctactttcgaggaagaggaactgagaggattgactacgaaaggggcaaaaacgagtcgtattctcccattattgtctgctaccacgcggtctagtagaataagcaaccagtcaacgctaagacaggtaatcaaaataccagtctgctggctacgggctagtttttacctcttttagaacccactgtaaaagtccgttgtaaagcccgttctcactgttggcgtttttttttttttggtttagtttcttatttttcatttttttctttcatgaccaaaaacaaacaaatctcgcgatttgtactgcggccactggggcgtggccaaaaaaatgacaaatttagaaaccttagtttctgatttttcctgttatgaggagatatgataaaaaatattactgctttattgttttttttttatctactgaaatagagaaacttacccaaggaggaggcaaaaaaaagagtatatatacagcagctaccattcagattttaatatattcttttctcttcttctacactattattataataattttactatattcatttttagcttaaaacctcatagaatattattcttcagtcactcgcttaaatacttatcaaaaatggacaagaaatactctattggtttggatatcgggaccaactccgtcggttgggctgtcatcaccgacgaatacaaggttccatccaagaaattcaaggtcttgggtaacactgacagacactctatcaagaagaatttgatcggtgctttgttgttcgactccggtgaaaccgctgaagctaccagattgaagcgtaccgctcgtcgtagatacactagacgtaaaaaccgtatttgttacttgcaagaaatcttttctaacgaaatggccaaggttgacgactctttcttccacagattggaagaatctttcttggttgaagaagacaagaagcacgaaagacatccaatcttcggtaacatcgttgacgaagttgcttaccacgaaaaataccctaccatctaccatttgagaaagaagttggtcgattccaccgacaaggctgatttgagattgatctatttggccttggctcacatgatcaagttcagaggtcacttcttgattgaaggtgacttgaacccagacaactctgacgtcgacaaattgttcatccaattggtccaaacctacaaccaattattcgaggaaaacccaattaacgcttctggtgttgatgctaaggccatcttatctgcccgtttgtccaagtctagacgtttggaaaacttgattgctcaattgcctggtgaaaagaaaaacggtttgttcggtaacttgatcgctttgtccttgggtttgaccccaaacttcaagtccaacttcgacttggctgaagatgccaagttgcaattgtccaaggacacctacgacgacgacttagacaacttgttggctcaaatcggtgaccaatacgccgacttgttcttggctgccaaaaacttatctgacgctatcttgttgtctgacatcttgagagttaacactgaaattaccaaggctccattgtctgcttctatgatcaaaagatacgacgaacaccaccaagatctgactttgttgaaggctttggttagacaacaattgccagaaaagtacaaggaaatcttcttcgaccaatccaaaaatggttacgccggttacattgacggtggtgcttctcaggaagaattctacaagttcatcaagccaattttggaaaagatggatggtactgaagaattattggttaagttgaacagagaagacttattgagaaagcaacgtaccttcgataacggttctatcccacaccaaatccacttgggtgaattgcacgccattttgagaagacaggaagatttctatccattcctaaaggacaacagagaaaagatcgaaaagatcttaactttcagaatcccatactacgtcggtccattggccagaggtaattctagattcgcttggatgaccagaaagtctgaagaaaccatcaccccatggaacttcgaagaagtcgtcgacaagggtgcttctgcccaatctttcatcgaaagaatgaccaactttgataagaacttgccaaacgagaaggtcttgccaaagcactctttgttgtacgaatacttcaccgtctacaacgaattaaccaaggttaaatacgttactgaaggtatgagaaagccagctttcctatccggtgaacaaaagaaggctattgttgacttgttgtttaagaccaacagaaaggtcactgttaagcaattgaaggaagactacttcaagaagattgaatgtttcgattccgtcgaaatctccggtgttgaagaccgtttcaatgcttctttgggcacctaccacgatttgttaaagatcatcaaggacaaggactttttagataacgaagaaaacgaagacatcttggaagatatcgttttgaccttgactcttttcgaggacagagaaatgattgaagagagattgaagacctacgctcacttgttcgacgataaagttatgaagcaactaaagagaagaagatacactggttggggtagattgtccagaaagttgattaacggtatcagagacaagcaatccggtaagactattttagactttttgaaatccgatggtttcgctaacagaaactttatgcaattgattcacgacgattctttgactttcaaggaagacattcaaaaagcccaagtctctggtcaaggtgattctttgcacgaacacatcgctaacttggctggttctccagctattaagaagggtatcttacaaaccgtcaaggtcgttgatgaattggtcaaagtcatgggtagacacaagccagaaaatattgtcatcgaaatggctagagaaaaccaaactactcaaaagggtcaaaagaactctagagaacgtatgaagagaattgaagaaggtatcaaggagttgggttctcaaattttgaaagaacacccagtcgaaaacactcaattacaaaacgaaaagctatacttgtactacttgcaaaacggtcgtgacatgtacgtcgaccaagaattggatatcaacagattgtctgactacgatgtcgatcatatcgtcccacaatcgttcttgaaggacgattccattgacaacaaagttttgactagatctgacaagaacagaggtaagtctgataacgttccatctgaagaagttgttaagaagatgaagaactactggagacaattgttgaatgctaagttgatcactcaaagaaagttcgacaacttgaccaaggctgaaagaggtggtttgtccgaattggacaaagccggtttcatcaagagacaattagtcgaaactagacaaatcaccaagcatgttgctcaaatcttggattccagaatgaacactaagtacgatgaaaacgacaaactaattagagaagttaaggtcatcactttgaagtctaagttggtttctgacttcagaaaggacttccaattttacaaggtcagagaaatcaacaactaccatcacgctcacgatgcctacttgaacgctgttgtcggtactgccttaatcaaaaagtacccaaagttggaatctgaattcgtttacggtgactacaaggtttacgatgttagaaagatgatcgccaagtctgaacaagaaattggtaaggccactgctaagtacttcttctactctaacatcatgaactttttcaagactgaaatcactttagctaacggtgaaattagaaagcgtccattgattgaaaccaatggtgaaactggtgaaattgtctgggacaagggtagagatttcgctaccgtcagaaaggttttgtctatgccacaagttaacatcgtcaagaagactgaagttcaaactggtggtttctctaaggaatccattttgccaaagagaaactctgacaagttgattgctagaaagaaggactgggatcctaagaagtacggtggtttcgactctccaactgttgcttactccgttttggtcgttgctaaggttgaaaagggtaagtctaagaagttgaagtctgttaaggaattgttgggtatcaccatcatggaaagatcctccttcgaaaagaacccaatcgactttttggaagctaagggttacaaggaagtcaagaaggatttgatcattaagttaccaaaatactccttgttcgaattggaaaacggtagaaagagaatgttggcctccgctggtgaactacaaaaaggtaacgaattggctttaccatctaagtacgttaacttcttgtacttggcttcccactacgaaaagttgaaaggttccccagaagacaacgaacaaaagcaattgtttgttgaacaacacaagcactacttggatgaaattattgaacaaatctccgaattctccaagagagtcattttggctgatgctaacttagataaggttttatccgcttacaacaagcacagagacaaaccaatcagagaacaagctgaaaacatcattcatttgttcactttaaccaacttgggtgctccagctgctttcaaatacttcgacactaccattgacagaaagagatacacttccaccaaagaagttttagatgctactttgattcaccaatctattaccggtttgtacgaaaccagaattgacttgtctcaattgggtggtgattccagagctgatccaaagaagaagagaaaggtgtaaaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttggcgctatcttaattactctggctgccaggcccgtgtagagggccgcaagaccttctgtacgccatatagtctctaagaacttgaacaagtttctagacctattgccgcctttcggatcgctattgttgcggccgccagctgaagcttcgtacgctgcaggtcgacgaattctaccgttcgtataatgtatgctatacgaagttatagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggtagaattcgaatcagatccactagtggcctatgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 136 - DNA, 5712 bp, Artificial Sequence
  Synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatggttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacacctaggatccgtcgacactggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactaggggcagggcatgctcatgtagagcgcctgctcgccgtccgaggcggtgccgtcgtacagggcggtgtccaggccgcagagggtgaaccccatccgccggtacgcgtggatcgccggtgcgttgacgttggtgacctccagccagaggtgcccggcgccccgctcgcgggcgaactccgtcgcgagccccatcaacgcgcgcccgaccccgtgcccccggtgctccggggcgacctcgatgtcctcgacggtcagccggcggttccagccggagtacgagacgaccacgaagcccgccaggtcgccgtcgtccccgtacgcgacgaacgtccgggagtccgggtcgccgtcctccccggcgtccgattcgtcgtccgattcgtcgtcggggaacaccttggtcaggggcgggtccaccggcacctcccgcagggtgaagccgtccccggtggcggtgacgcggaagacggtgtcggtggtgaaggacccatccagtgcctcgatggcctcggcgtcccccgggacactggtgcggtaccggtaagccgtgtcgtcaagagtggtcattttacatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgaggccttaagttcgaacgtacgagctccggcattgcgaataccgctttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttaacaaagatatgctattgaagtgcaagatggaaacgcagaaaatgaaccggggatgcgacgtgcaagattacctatgcaatagatgcaatagtttctccaggaaccgaaatacatacattgtcttccgtaaagcgctagactatatattattatacaggttcaaatatactatctgtttcagggaaaactcccaggttcggatgttcaaaattcaatgatgggtaacaagtacgatcgtaaatctgtaaaacagtttgtcggatattaggctgtatctcctcaaagcgtattcgaatatcattgagaagctgcagcgtcacatcggataataatgatggcagccattgtagaagtgccttttgcatttctagtctctttctcggtctagctagttttactacatcgcgaagatagaatcttagatcacactgcctttgctgagctggatcaatagagtaacaaaagagtggtaaggcctcgttaaaggacaaggacctgagcggaagtgtatcgtacagtagacggagtatactaggtatagtctatagtccgtggaattaattctcatgtttgacagcttatcatcgataatccggagctagcatgcggccgctctagaactagtggatcccccgggctgcaggaattcgatatcaagcttatcgataccgtcgacctcgagggggggcccggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 137 - DNA, 2540 bp, Artificial Sequence
  Synthetic construct
aagcgacttccaatcgctttgcatatccagtaccacacccacaggcgtttgtgccgtaaaaactaaaacgagcccccaccaaagaacaaaaaagaaggtgctgggcccccactttcttcccttgcacgtgataggaagatggctacagaaacaagaagatggaaatcgaaggaaagagggagactggaagctgtaaaaactgaaatgaaaaaaaaaaaaaaaaaaaaaaacaagaagctgaaaatggaagactgaaatttgaaaaatggtaaaaaaaaaaaagaaacacgaagctaaaaacctggattccattttgagaagaagcaagaaaggtaagtatggtaacgaccgtacaggcaagcgcgaaggcaaatggaaaagctggagtccggaagataatcatttcatcttcttttgttagaacagaacagtggatgtccctcatctcggtaacgtattgtccatgccctagaactctctgtccctaaaaagaggacaaaaacccaatggtttccccagcttccagtggagccaccgatcccactggaaaccactggacaggaagagaaaatcacggacttcctctattgaaggataattcaacactttcaccagatcccaaatgtcccgcccctattcccgtgttccatcacgtaccataacttaccatttcatcacgttctctatggcacactggtactgcttcgactgctttgcttcatcttctctatgggccaatgagctaatgagcacaatgtgctgcgaaataaagggatatctaatttatattattacattataatatgtactagtgtggttattggtaattgtacttaattttgatatataaagggtggatctttttcattttgaatcagaattggaattgcaacttgtctcttgtcactattacttaatagtaattatatttcttattaaccttttttttaagtcaaaacaccaaggacaagaactactcttcaaaggtatttcaagttatcatacgtgtcacacacgcttcacagtttcaagtaaaaaaaaagaatattacacaatggactacgctaacatcttgactgccattcctttggaattcaccccacaagatgacattgtcttgttggaaccataccactacttaggtaagaacccaggtaaggaaatcagatctcaattgattgaagctttcaactactggttagatgtcaagaaggaagacttggaagttatccaaaatgttgttggtatgttgcacaccgcttctttgttgatggatgatgttgaagattcttccgtcttgagaagaggttctccagttgctcatttgatctacggtattccacaaaccatcaacactgctaactacgtttacttcttggcttaccaagaaatcttcaaattgcgtccaactccaattccaatgccagttatcccaccatcttctgcttctttgcaatcttctgtctcctccgcctcctcttcctcttctgcctcctctgaaaacggtggtacctccactccaaactcccaaatcccattctccaaggacacctacttggacaaggttatcactgacgaaatgttgtctttgcaccgtggtcaaggtttggaattattctggagagactctttgacctgtccatctgaagaagaatacgtcaagatggtcttgggtaagaccggtggtttgttcagaattgctgtcagattgatgatggccaagtctgaatgtgacattgactttgttcaattggttaacttgatttccatctacttccaaatcagagatgactacatgaacttgcaatcctctgaatacgctcacaacaagaacttcgctgaagacttgactgaaggtaagttctccttcccaaccattcactccattcacgctaacccatcttccagattggttatcaacactttacaaaagaagtccacttctccagaaatcttacatcactgtgtcaactacatgagaactgaaacccactctttcgaatacactcaagaagtcttgaacactttatctggtgctttggaaagagaattgggtagattacaaggtgaatttgctgaagctaactccaagatcgatttgggtgacgttgaatctgaaggtagaaccggtaagaacgtcaaattggaagccatcttgaagaaattggctgatatccctctataaagtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggatcctcttgcccatcgaacgtacaagtactcctctgttctctccttcctttgcttt

SEQ ID NO: 138 - DNA, 2540 bp, Artificial Sequence
  Synthetic construct
aagcgacttccaatcgctttgcatatccagtaccacacccacaggcgtttgtgcgttcctcatcactagaagccgaactgttgtcttcagtggggattggttcgacattttgccaattgctgtcgatgtaccctttcaaagccatgtaccttaaatcttcatccttggcaagtagattcatcgggtgtgtttgaagtaagaatatttgcttgtttttatggtatcaaaggtatatgttgtagaagacaatttccggtaatccaattgtctgtctgctcagtttagcacatgtatagtacgttgcacatagtctacaatattcagcattcagcattcagtatacagcatatggctaaatgatcacaaatgtgattgatgatttgacacgactagaaaagagaacgaaaaagggaaattccatgtcacgtgcgttggcacgtgacatggaatatcgaagaaagaaaaaaaaaacgatctcgtcctagtggaagcccagagtctggtccccccggagtcttcccaaaacaagaagctgacacatgttgacacagaacaccccacagcaaatgcaccacgctacgtagatcaggaagcttaactctagcgacctgtcgctcgccccacagaacctcacccgagaaccacacattacacgccgccagctcccactatactcatcttgcttcccttaagcgttctcacgattcgttcgctgcccttcttcaagagtcttctgattctaattctcattcgaaatcctctacagttaatgaattgcttgacatgacattcattgtctcatggttttggctttttggcttttgtcttttaaagctatatcaactttacatataaatatacgtcaaaaggggattcattaattagaaaattctctttttcaatagttgctattcattatcaatctattcaactcaattggttattattttcatctttttgtcatcctaaaccatcaacaatatttaaatatatctgttgctacattaagagttacttcagaaataacaaaaaaatcgatcaagaattaataaaaatggactacgctaacatcttgactgccattcctttggaattcaccccacaagatgacattgtcttgttggaaccataccactacttaggtaagaacccaggtaaggaaatcagatctcaattgattgaagctttcaactactggttagatgtcaagaaggaagacttggaagttatccaaaatgttgttggtatgttgcacaccgcttctttgttgatggatgatgttgaagattcttccgtcttgagaagaggttctccagttgctcatttgatctacggtattccacaaaccatcaacactgctaactacgtttacttcttggcttaccaagaaatcttcaaattgcgtccaactccaattccaatgccagttatcccaccatcttctgcttctttgcaatcttctgtctcctccgcctcctcttcctcttctgcctcctctgaaaacggtggtacctccactccaaactcccaaatcccattctccaaggacacctacttggacaaggttatcactgacgaaatgttgtctttgcaccgtggtcaaggtttggaattattctggagagactctttgacctgtccatctgaagaagaatacgtcaagatggtcttgggtaagaccggtggtttgttcagaattgctgtcagattgatgatggccaagtctgaatgtgacattgactttgttcaattggttaacttgatttccatctacttccaaatcagagatgactacatgaacttgcaatcctctgaatacgctcacaacaagaacttcgctgaagacttgactgaaggtaagttctccttcccaaccattcactccattcacgctaacccatcttccagattggttatcaacactttacaaaagaagtccacttctccagaaatcttacatcactgtgtcaactacatgagaactgaaacccactctttcgaatacactcaagaagtcttgaacactttatctggtgctttggaaagagaattgggtagattacaaggtgaatttgctgaagctaactccaagatcgatttgggtgacgttgaatctgaaggtagaaccggtaagaacgtcaaattggaagccatcttgaagaaattggctgatatccctctataaagtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggatcctcttgcccatcgaacgtacaagtactcctctgttctctccttcctttgcttt

SEQ ID NO: 139 - DNA, 2140 bp, Artificial Sequence
  Synthetic construct
aagcgacttccaatcgctttgcatatccagtaccacacccacaggcgtttgtgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaaatggactacgctaacatcttgactgccattcctttggaattcaccccacaagatgacattgtcttgttggaaccataccactacttaggtaagaacccaggtaaggaaatcagatctcaattgattgaagctttcaactactggttagatgtcaagaaggaagacttggaagttatccaaaatgttgttggtatgttgcacaccgcttctttgttgatggatgatgttgaagattcttccgtcttgagaagaggttctccagttgctcatttgatctacggtattccacaaaccatcaacactgctaactacgtttacttcttggcttaccaagaaatcttcaaattgcgtccaactccaattccaatgccagttatcccaccatcttctgcttctttgcaatcttctgtctcctccgcctcctcttcctcttctgcctcctctgaaaacggtggtacctccactccaaactcccaaatcccattctccaaggacacctacttggacaaggttatcactgacgaaatgttgtctttgcaccgtggtcaaggtttggaattattctggagagactctttgacctgtccatctgaagaagaatacgtcaagatggtcttgggtaagaccggtggtttgttcagaattgctgtcagattgatgatggccaagtctgaatgtgacattgactttgttcaattggttaacttgatttccatctacttccaaatcagagatgactacatgaacttgcaatcctctgaatacgctcacaacaagaacttcgctgaagacttgactgaaggtaagttctccttcccaaccattcactccattcacgctaacccatcttccagattggttatcaacactttacaaaagaagtccacttctccagaaatcttacatcactgtgtcaactacatgagaactgaaacccactctttcgaatacactcaagaagtcttgaacactttatctggtgctttggaaagagaattgggtagattacaaggtgaatttgctgaagctaactccaagatcgatttgggtgacgttgaatctgaaggtagaaccggtaagaacgtcaaattggaagccatcttgaagaaattggctgatatccctctataaagtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggatcctcttgcccatcgaacgtacaagtactcctctgttctctccttcctttgcttt

SEQ ID NO: 140 - DNA, 3431 bp, Artificial Sequence
  Synthetic construct
ttgcccatcgaacgtacaagtactcctctgttctctccttcctttgctttgtgcttttctttttttgcggtcacccccatgtggcggggaggcagaggagtaggtagagcaacgaatcctactatttatccaaattagtctaggaactctttttctagattttttagatttgagggcaagcgctgttaacgactcagaaatgtaagcactacggagtagaacgagaaatccgccataggtggaaatcctagcaaaatcttgcttaccctagctagcctcaggtaagctagccttagcctgtcaaatttttttcaaaatttggtaagtttctactagcaaagcaaacacggttcaacaaaccgaaaactccactcattatacgtggaaaccgaaacaaaaaaacaaaaaccaaaatactcgccaatgagaaagttgctgcgtttctactttcgaggaagaggaactgagaggattgactacgaaaggggcaaaaacgagtcgtattctcccattattgtctgctaccacgcggtctagtagaataagcaaccagtcaacgctaagacaggtaatcaaaataccagtctgctggctacgggctagtttttacctcttttagaacccactgtaaaagtccgttgtaaagcccgttctcactgttggcgtttttttttttttggtttagtttcttatttttcatttttttctttcatgaccaaaaacaaacaaatctcgcgatttgtactgcggccactggggcgtggccaaaaaaatgacaaatttagaaaccttagtttctgatttttcctgttatgaggagatatgataaaaaatattactgctttattgttttttttttatctactgaaatagagaaacttacccaaggaggaggcaaaaaaaagagtatatatacagcaggtaccattcagattttaatatattcttttctcttcttctacactattattataataattttactatattcatttttagcttaaaacctcatagaatattattcttcagtcactcgcttaaatacttatcaaaaatgaccgctttggcttactaccaaatccacttgatctacactttgccaatcttaggtttgctaggtttgttgacttctccaattttgaccaaattcgacatctacaagatttctatcttagtctttattgctttctctgctaccactccatgggactcctggatcatcagaaacggtgcctggacctacccatctgctgaatctggtcaaggtgttttcggtacctttttggatgtcccatacgaagaatacgccttctttgttatccaaaccgtcatcaccggtttggtttacgttttggctaccagacatttgttgccatctttggctctaccaaagacccgttcttctgccttgtctctagctttgaaggctttaatcccattgccaatcatctatttgttcaccgctcatccatctccatccccagatcctttggttactgaccactacttctacatgagagctttgtctttgttgatcaccccaccaaccatgttgttggctgctttatctggtgaatacgctttcgactggaaatctggtagagctaagtccaccattgctgccatcatgatcccaactgtctacttgatctgggttgactacgttgccgttggtcaagactcctggtccatcaacgatgaaaagattgtcggttggagattaggtggtgtcttgccaattgaagaagctatgttcttcttattgaccaacttgatgatcgttttgggtttgtctgcctgtgaccacactcaagccttgtacttgttgcacggtagaactatctacggtaacaagaagatgccatcttctttcccattaatcactccaccagttttgtccttgttcttctcctccagaccatactcctcccaaccaaagagagatttggaattggctgtcaagttgttggaaaagaagtccagatctttcttcgttgcttctgccggtttcccatctgaagtcagagaaagattggttggtttgtacgctttctgtcgtgtcaccgatgacttgattgactctccagaagtttcctccaacccacacgctaccattgacatggtttccgatttcttgactttattattcggtcctccattgcacccatctcaaccagacaagattttgtcttctccattattaccaccttcccacccatccagaccaactggtatgtacccattaccaccacctccatctttgtctccagctgaattggtccaattcttgactgaacgtgtcccagttcaataccacttcgctttcagattgttggccaaattgcaaggtttgattccaagatacccattggatgaattattgagaggttacaccactgacttgatcttcccattgtccactgaagccgtccaagctagaaagaccccaattgaaactactgctgacttgttggactacggtttgtgtgttgccggttctgttgctgaattgttggtctacgtttcctgggcttccgctccatcccaagttccagctactattgaagaaagagaagctgttttggtcgcctctcgtgaaatgggtaccgctttgcaattggtcaacattgccagagatatcaagggtgacgctactgaaggtagattctacttgccattgtctttctttggtttgagagatgaatccaaattggccattccaactgactggactgaaccaagacctcaagatttcgacaaattgttgtctctatctccatcttccactttaccatcctctaacgcttctgaatccttcagattcgaatggaagacctactctttgccattggttgcttacgctgaagatttggctaagcactcttacaagggtattgacagattaccaactgaagtccaagctggtatgagagctgcttgtgcttcttacttgttgattggtcgtgaaatcaaggttgtctggaagggtgatgtcggtgaaagaagaaccgttgctggttggagaagagtcagaaaggttttgtctgttgtcatgtccggttgggaaggtcaataaagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacacctccggatcgatgtacacaaccgactgcacccaaacgaacacaaatcttagca

SEQ ID NO: 141 - DNA, 3431 bp, Artificial Sequence
  Artificila construct
ttgcccatcgaacgtacaagtactcctctgttctctccttcctttgctttgtgcgagcctgtccaagcaaatgccttctcataaatggtgccaaagacccgcaagcccaaagcaattaccccccaaaaagaaatgatatagtgcaagatacgtatatgaccatgacttgactaggtgaaacagtgcagaaacagccgcacaaaagcagccctaaccctcagagtcgattttactctttcaggtaataaagcctcgacatcaattttagacagaagccaggctggcctcgagattatagccataggcaagcaagaggagagaaggggaggccccccatggggggcctcccccccgctgtcaaggtttggcagaacctagcttcattaggccactagcccagcctaaaacgtcaacgggcaggaggaacactcccacaagacggcgtagtattctcgattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgaccgctttggcttactaccaaatccacttgatctacactttgccaatcttaggtttgctaggtttgttgacttctccaattttgaccaaattcgacatctacaagatttctatcttagtctttattgctttctctgctaccactccatgggactcctggatcatcagaaacggtgcctggacctacccatctgctgaatctggtcaaggtgttttcggtacctttttggatgtcccatacgaagaatacgccttctttgttatccaaaccgtcatcaccggtttggtttacgttttggctaccagacatttgttgccatctttggctctaccaaagacccgttcttctgccttgtctctagctttgaaggctttaatcccattgccaatcatctatttgttcaccgctcatccatctccatccccagatcctttggttactgaccactacttctacatgagagctttgtctttgttgatcaccccaccaaccatgttgttggctgctttatctggtgaatacgctttcgactggaaatctggtagagctaagtccaccattgctgccatcatgatcccaactgtctacttgatctgggttgactacgttgccgttggtcaagactcctggtccatcaacgatgaaaagattgtcggttggagattaggtggtgtcttgccaattgaagaagctatgttcttcttattgaccaacttgatgatcgttttgggtttgtctgcctgtgaccacactcaagccttgtacttgttgcacggtagaactatctacggtaacaagaagatgccatcttctttcccattaatcactccaccagttttgtccttgttcttctcctccagaccatactcctcccaaccaaagagagatttggaattggctgtcaagttgttggaaaagaagtccagatctttcttcgttgcttctgccggtttcccatctgaagtcagagaaagattggttggtttgtacgctttctgtcgtgtcaccgatgacttgattgactctccagaagtttcctccaacccacacgctaccattgacatggtttccgatttcttgactttattattcggtcctccattgcacccatctcaaccagacaagattttgtcttctccattattaccaccttcccacccatccagaccaactggtatgtacccattaccaccacctccatctttgtctccagctgaattggtccaattcttgactgaacgtgtcccagttcaataccacttcgctttcagattgttggccaaattgcaaggtttgattccaagatacccattggatgaattattgagaggttacaccactgacttgatcttcccattgtccactgaagccgtccaagctagaaagaccccaattgaaactactgctgacttgttggactacggtttgtgtgttgccggttctgttgctgaattgttggtctacgtttcctgggcttccgctccatcccaagttccagctactattgaagaaagagaagctgttttggtcgcctctcgtgaaatgggtaccgctttgcaattggtcaacattgccagagatatcaagggtgacgctactgaaggtagattctacttgccattgtctttctttggtttgagagatgaatccaaattggccattccaactgactggactgaaccaagacctcaagatttcgacaaattgttgtctctatctccatcttccactttaccatcctctaacgcttctgaatccttcagattcgaatggaagacctactctttgccattggttgcttacgctgaagatttggctaagcactcttacaagggtattgacagattaccaactgaagtccaagctggtatgagagctgcttgtgcttcttacttgttgattggtcgtgaaatcaaggttgtctggaagggtgatgtcggtgaaagaagaaccgttgctggttggagaagagtcagaaaggttttgtctgttgtcatgtccggttgggaaggtcaataaagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacacctccggatcgatgtacacaaccgactgcacccaaacgaacacaaatcttagca

SEQ ID NO: 142 - DNA, 3031 bp, Artificial Sequence
  Artificial contruct
ttgcccatcgaacgtacaagtactcctctgttctctccttcctttgctttgtgcttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagacaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatgaccgctttggcttactaccaaatccacttgatctacactttgccaatcttaggtttgctaggtttgttgacttctccaattttgaccaaattcgacatctacaagatttctatcttagtctttattgctttctctgctaccactccatgggactcctggatcatcagaaacggtgcctggacctacccatctgctgaatctggtcaaggtgttttcggtacctttttggatgtcccatacgaagaatacgccttctttgttatccaaaccgtcatcaccggtttggtttacgttttggctaccagacatttgttgccatctttggctctaccaaagacccgttcttctgccttgtctctagctttgaaggctttaatcccattgccaatcatctatttgttcaccgctcatccatctccatccccagatcctttggttactgaccactacttctacatgagagctttgtctttgttgatcaccccaccaaccatgttgttggctgctttatctggtgaatacgctttcgactggaaatctggtagagctaagtccaccattgctgccatcatgatcccaactgtctacttgatctgggttgactacgttgccgttggtcaagactcctggtccatcaacgatgaaaagattgtcggttggagattaggtggtgtcttgccaattgaagaagctatgttcttcttattgaccaacttgatgatcgttttgggtttgtctgcctgtgaccacactcaagccttgtacttgttgcacggtagaactatctacggtaacaagaagatgccatcttctttcccattaatcactccaccagttttgtccttgttcttctcctccagaccatactcctcccaaccaaagagagatttggaattggctgtcaagttgttggaaaagaagtccagatctttcttcgttgcttctgccggtttcccatctgaagtcagagaaagattggttggtttgtacgctttctgtcgtgtcaccgatgacttgattgactctccagaagtttcctccaacccacacgctaccattgacatggtttccgatttcttgactttattattcggtcctccattgcacccatctcaaccagacaagattttgtcttctccattattaccaccttcccacccatccagaccaactggtatgtacccattaccaccacctccatctttgtctccagctgaattggtccaattcttgactgaacgtgtcccagttcaataccacttcgctttcagattgttggccaaattgcaaggtttgattccaagatacccattggatgaattattgagaggttacaccactgacttgatcttcccattgtccactgaagccgtccaagctagaaagaccccaattgaaactactgctgacttgttggactacggtttgtgtgttgccggttctgttgctgaattgttggtctacgtttcctgggcttccgctccatcccaagttccagctactattgaagaaagagaagctgttttggtcgcctctcgtgaaatgggtaccgctttgcaattggtcaacattgccagagatatcaagggtgacgctactgaaggtagattctacttgccattgtctttctttggtttgagagatgaatccaaattggccattccaactgactggactgaaccaagacctcaagatttcgacaaattgttgtctctatctccatcttccactttaccatcctctaacgcttctgaatccttcagattcgaatggaagacctactctttgccattggttgcttacgctgaagatttggctaagcactcttacaagggtattgacagattaccaactgaagtccaagctggtatgagagctgcttgtgcttcttacttgttgattggtcgtgaaatcaaggttgtctggaagggtgatgtcggtgaaagaagaaccgttgctggttggagaagagtcagaaaggttttgtctgttgtcatgtccggttgggaaggtcaataaagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacacctccggatcgatgtacacaaccgactgcacccaaacgaacacaaatcttagca

SEQ ID NO: 143 - DNA, 2758 bp, Artificial Sequence
  Synthetic construct
cggatcgatgtacacaaccgactgcacccaaacgaacacaaatcttagcagtgccaaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctgttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgacacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaatagaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtccctcacgctttccggcatcttccagaccacagtatatccatccgcctcctgttg

SEQ ID NO: 144 - DNA, 2758 bp, Artificial Sequence
  Synthetic construct
cggatcgatgtacacaaccgactgcacccaaacgaacacaaatcttagcagtgcaacatatatacacaattacagtaacaataacaagaggacagatactaccaaaatgtgtggggaagcgggtaagctgccacagcaattaatgcacaacatttaacctacattcttccttatcggatcctcaaaacccttaaaaacatatgcctcaccctaacatattttccaattaaccctcaatatttctctgtcacccggcctctattttccattttcttctttacccgccacgcgtttttttctttcaaatttttttcttctttcttctttttcttccacgtcctcttgcataaataaataaaccgttttgaaaccaaactcgcctctctctctcctttttgaaatatttttgggtttgtttgatcctttccttcccaatctctcttgtttaatatatattcatttatatcacgctctctttttatcttcctttttttcctctctcttgtattcttccttcccctttctactcaaaccaagaagaaaaagaaaaggtcaatctttgttaaagaataggatcttctactacatcagcttttagatttttcacgcttactgcttttttcttcccaagatcgaaaatttactgaattaacaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtccctcacgctttccggcatcttccagaccacagtatatccatccgcctcctgttg

SEQ ID NO: 145 - DNA, 3158 bp, Artificial Sequence
  Synthetic construct
cggatcgatgtacacaaccgactgcacccaaacgaacacaaatcttagcagtgccgtatccctatctggattaacatcactgccacagatcgaattgcaagaagccacacttcacgtgatccactcgttcatcaggtttgtagcttcatggcgcaggacttctgatgatgaactatctggctcatccggatggatcacaaggatggataccctcagacagtacgtttccgtatggagcgatcttacaagaaccaacagttgatcctattactttttttttattttttgtccctccgggatggcaagagggacaaagaagaatcttcgttcttctttcttgttctcaacttcccagcttccgtgtgattaccctccgggacaacagaaaaactggcattcggtatcccgggaatctgctgagaaggaaagaaaacgaaaaaaaaattgtacatttgtgtcacattatgaattacaggaagtcagaaaacaggcagcacatgtctcgcacatgcatgtccatcagacgagacattatgagacatgcacgcgtgtgagagacatagcaaaagtctctccagtacacacagaaagacacgttcacaatccaggcaccccacagagaaaaaaaaaagaagaagcccggaagctggcacgccatcatcaaccaccgctcggtttacacgcatcccaactgtcttttttttctggaatcctataataactggcatctggaaatcacgttgtatgttgcaccatagtgactggctgtctgactagcaaacattgattccctgattcccatttggctcaattttgatgagaaacagttgattgattcttgtcaatttttttttctttggaccaccaccaaccaattgacattgaagtactttcccatgatttgaggttatataaaaggacgttcaaatcactttcaaggttaattcagttttgtcaattgatttaagttcaattgttaacaaatttaatttaattcgaaacaaaccaaaccaattcatttgaattaacaaaccaacccacaaaacaaaaaaaaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtccctcacgctttccggcatcttccagaccacagtatatccatccgcctcctgttg

SEQ ID NO: 146 - DNA, 2758 bp, Artificial Sequence
  Synthetic construct
cggatcgatgtacacaaccgactgcacccaaacgaacacaaatcttagcagtgccaaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctgttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgacacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaatagaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtccctcagaaagcctgtatgcgaagccacaatcctttccaacagaccatactaagt

SEQ ID NO: 147 - DNA, 2758 bp, Artificial Sequence
  Synthetic construct
cggatcgatgtacacaaccgactgcacccaaacgaacacaaatcttagcagtgcaacatatatacacaattacagtaacaataacaagaggacagatactaccaaaatgtgtggggaagcgggtaagctgccacagcaattaatgcacaacatttaacctacattcttccttatcggatcctcaaaacccttaaaaacatatgcctcaccctaacatattttccaattaaccctcaatatttctctgtcacccggcctctattttccattttcttctttacccgccacgcgtttttttctttcaaatttttttcttctttcttctttttcttccacgtcctcttgcataaataaataaaccgttttgaaaccaaactcgcctctctctctcctttttgaaatatttttgggtttgtttgatcctttccttcccaatctctcttgtttaatatatattcatttatatcacgctctctttttatcttcctttttttcctctctcttgtattcttccttcccctttctactcaaaccaagaagaaaaagaaaaggtcaatctttgttaaagaataggatcttctactacatcagcttttagatttttcacgcttactgcttttttcttcccaagatcgaaaatttactgaattaacaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtccctcagaaagcctgtatgcgaagccacaatcctttccaacagaccatactaagt

SEQ ID NO: 148 - DNA, 3158 bp, Artificial Sequence
  Synthetic construct
cggatcgatgtacacaaccgactgcacccaaacgaacacaaatcttagcagtgccgtatccctatctggattaacatcactgccacagatcgaattgcaagaagccacacttcacgtgatccactcgttcatcaggtttgtagcttcatggcgcaggacttctgatgatgaactatctggctcatccggatggatcacaaggatggataccctcagacagtacgtttccgtatggagcgatcttacaagaaccaacagttgatcctattactttttttttattttttgtccctccgggatggcaagagggacaaagaagaatcttcgttcttctttcttgttctcaacttcccagcttccgtgtgattaccctccgggacaacagaaaaactggcattcggtatcccgggaatctgctgagaaggaaagaaaacgaaaaaaaaattgtacatttgtgtcacattatgaattacaggaagtcagaaaacaggcagcacatgtctcgcacatgcatgtccatcagacgagacattatgagacatgcacgcgtgtgagagacatagcaaaagtctctccagtacacacagaaagacacgttcacaatccaggcaccccacagagaaaaaaaaaagaagaagcccggaagctggcacgccatcatcaaccaccgctcggtttacacgcatcccaactgtcttttttttctggaatcctataataactggcatctggaaatcacgttgtatgttgcaccatagtgactggctgtctgactagcaaacattgattccctgattcccatttggctcaattttgatgagaaacagttgattgattcttgtcaatttttttttctttggaccaccaccaaccaattgacattgaagtactttcccatgatttgaggttatataaaaggacgttcaaatcactttcaaggttaattcagttttgtcaattgatttaagttcaattgttaacaaatttaatttaattcgaaacaaaccaaaccaattcatttgaattaacaaaccaacccacaaaacaaaaaaaaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtccctcagaaagcctgtatgcgaagccacaatcctttccaacagaccatactaagt

SEQ ID NO: 149 - DNA, 245 bp, Artificial Sequence
  Synthetic construct
cggcattattgtgtatggctcaataattttataaaaaaaggaactattggttcttagtattttcttgctagaagacatattcttaccaatcctttcataagctaattatgccatccatatagcaagagaatccggtgggggcgccatgcctatccggcggcaacattattactctggtatacgggcgtaactccaaagcgacttccaatcgctttgcatatccagtaccacacccacaggcgttt

SEQ ID NO: 150 - DNA, 372 bp, Artificial Sequence
  Synthetic construct
cattatatcgaggaaagccctgcgaacgtgaagtgaaaaggacggttgtcctttttcctgttcttcgaggatcctgaacaggatgtcagtagggcgggccttttctttttattgtgcaggtacgcatgtttctttgacacaaaatagtctggattcgccagccagtggcacttttgatgccatttccaccacagaaaacgtctgagtattcagccatgggaggggagtgttgaaaggggagaagcagcccacttctctgtcttgacacaaaccgcagattgcgtcacggttctgcggacgccgttagcccattggtgtcaagaagcgacttccaatcgctttgcatatccagtaccacacccacaggcgttt

SEQ ID NO: 151 - DNA, 649 bp, Artificial Sequence
  Synthetic construct
taaaggaggtgcacgcattatggagaccactacgatacgatagctgcgttgttgttgaaggggtttcttaaggttgttttcgttgaaggtaaatattggtcgtttttgtgcagcatattgtcctctagatgcaaactctgcaggtccatttgcagtaaagtgagttgcctctcgaagaatcattaatttcgtataaccgtcactattaaagtcagaaaataaattctgtcgtagacaatgttaccataatgttcttgtccattttgcatacactttaaatattcatttgatttctcagggttcatgatcataataaattgcgcattcgcaaggcggtagtattataatggggtccatcattctgtagcaagaagttacagtacgctgttcaagcgttaaacaagataagtaatctcgaatgaaacattcatatttcgcatgagccaacatacagttgctgagtaatcttcattgcgcttatttatcggcattgagattgtaaaggaagtaaaacgcatttttgcagatctgttctcttatgtatttttaatcgtccttgtatggaagtatcaaaggggacgttcttcacctccttggaaaagcgacttccaatcgctttgcatatccagtaccacacccacaggcgttt

SEQ ID NO: 152 - DNA, 574 bp, Artificial Sequence
  Synthetic construct
agaaagcctgtatgcgaagccacaatcctttccaacagaccatactaagtgaagtatggatctttgaaacccttttattttattttactttttttagaatgacctgttcccgacactatgtaagatctagcttttaacatattatggaaacctgaaatgtaaaatctgaatttttgtatatgtgtttatatttgggtagttcttttgaggaaagcatgcatagacttgctgtacgaactttatgtgacttgtagtgacgctgtttcatgagactttagccctttgaacatattatcatatctcagcttgaaatactatagatttacttttgcagccatttcttggtgctccaaggttgtgcgtatctattacttaatttctgtccttgccaagttttgcagcagggcggtcacaagactcctctgccgtcattccttagtccttcgggaacacacttatttatgtatttgtattctacaattctacggtgcacaagggttgggcactgttgagctcagcacgcaactattgctggcatgaagataagattgatttttggaagaataagcttgtg

SEQ ID NO: 153 - DNA, 546 bp, Artificial Sequence
  Artificila construct
agaaagcctgtatgcgaagccacaatcctttccaacagaccatactaagttcttggcggccgtacgcatatagtatactaatgcggtaacggctacctcctacgtctgtatcaaaaaagttcgctctggtcctatcaatattttctcccacacgaggattctgtggttttgcagccacatctacaggatgttgactttttgtttgtttacgtagtttgtttcaacgctttcgaagatgtggcgctggtgcaagtcatctaagttggttactgataacaaattgtgacaaggatgtagtggatgcgtaggagaccaaaatgacatctgacacaaaaaaaagtagataacgaaaacaggacaaaggtgtcattttgttttgccaaggagaattataatcttagtgtgaagatactttcattagacacataaatttacgttcgacacacttttttcttactcctccccttatcaaggatacctggttgattctacgtcgtcctcttcactttggttaattcacctttgcccttcacctcgtggtgtgcg

SEQ ID NO: 154 - DNA, 675 bp, Artificial Sequence
  Synthetic construct
agaaagcctgtatgcgaagccacaatcctttccaacagaccatactaagttgatgggacgtcagcactgtacttgtttttgcgactagattgtaaatcattctttatttaatctctttctttaactactgcttaaagtataatttggtccgtagtttaataactatactaagcgtaacaatgcatactgacattataagcctgaacattacgagtttaagttgtatgtaggcgttctgtaagaggttactgcgtaaattatcaacgaatgcattggtgtatttgcgaaagctacttcttttaacaagtatttacataagaataatggtgatctgctcaactgatttggtgataactctaacttttttagcaacaatttaaaagataattcgaacatatataacagtaggaagaatttgtgtacgtcaaattaagataatttagcattaccaaagttattaacctaaacataaaatatatatgagacacatgtggaaatcgtatgaaacaactgttatgaaactgacaagaatgaatatatagagtaagctccgcttgtaaagaggaatcacttaagtgtataaatgtctcgacgattactttagatccaagattgatgattgatattactctgtaatacttaagctcttttaatagctcactgttgtattacggg

SEQ ID NO: 155 - DNA, 22 bp, Artificial Sequence
  Synthetic construct
aagcgacttccaatcgctttgc

SEQ ID NO: 156 - DNA, 21 bp, Artificial Sequence
  Synthetic construct
aaagcaaaggaaggagagaac

SEQ ID NO: 157 - DNA, 20 bp, Artificial Sequence
  Synthetic construct
ttgcccatcgaacgtacaag

SEQ ID NO: 158 - DNA, 23 bp, Artificial Sequence
  Synthetic construct
tgctaagatttgtgttcgtttgg

SEQ ID NO: 159 - DNA, 20 bp, Artificial Sequence
  Synthetic construct
cggatcgatgtacacaaccg

SEQ ID NO: 160 - DNA, 72 bp, Artificial Sequence
  Synthetic construct
acttagtatggtctgttggaaaggattgtggcttcgcatacaggctttctgagggacgttgatttaaggtgg

SEQ ID NO: 161 - DNA, 19 bp, Artificial Sequence
  Synthetic construct
cggcattattgtgtatggc

SEQ ID NO: 162 - DNA, 73 bp, Artificial Sequence; identical to SEQ ID NO: 32
  Synthetic construct

SEQ ID NO: 163 - DNA, 20 bp, Artificial Sequence
  Synthetic construct
cattatatcgaggaaagccc

SEQ ID NO: 164 - DNA, 71 bp, Artificial Sequence
  Synthetic construct
aaacgcctgtgggtgtggtactggatatgcaaagcgattggaagtcgcttcttgacaccaatgggctaacg

SEQ ID NO: 165 - DNA, 23 bp, Artificial Sequence
  Synthetic construct
taaaggaggtgcacgcattatgg

SEQ ID NO: 166 - DNA, 72 bp, Artificial Sequence
  Synthetic construct
aaacgcctgtgggtgtggtactggatatgcaaagcgattggaagtcgcttttccaaggaggtgaagaacgtc

SEQ ID NO: 167 - DNA, 90 bp, Artificial Sequence; identical to SEQ ID NO: 33
  Synthetic construct

SEQ ID NO: 168 - DNA, 24 bp, Artificial Sequence
  Synthetic construct
cacaagcttattcttccaaaaatc

SEQ ID NO: 169 - DNA, 73 bp, Artificial Sequence
  Synthetic construct
agaaagcctgtatgcgaagccacaatcctttccaacagaccatactaagttcttggcggccgtacgcatatag

SEQ ID NO: 170 - DNA, 20 bp, Artificial Sequence
  Synthetic construct
cgcacaccacgaggtgaagg

SEQ ID NO: 171 - DNA, 71 bp, Artificial Sequence
  Synthetic construct
agaaagcctgtatgcgaagccacaatcctttccaacagaccatactaagtgatgggacgtcagcactgtac

SEQ ID NO: 172 - DNA, 20 bp, Artificial Sequence
  Synthetic construct
cccgtaatacaacagtgagc

SEQ ID NO: 173 - DNA, 553 bp, Artificial Sequence
  Synthetic construct
catgtttgacagcttatcatcgataatccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccgagcttggcgtaatcatggtcatagctgtttcctgtgtg

SEQ ID NO: 174 - DNA, 553 bp, Artificial Sequence
  Synthetic construct
catgtttgacagcttatcatcgataatccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcagaaaactcttagcttttccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccgagcttggcgtaatcatggtcatagctgtttcctgtgtg

SEQ ID NO: 175 - DNA, 553 bp, Artificial Sequence
  Synthetic construct
catgtttgacagcttatcatcgataatccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatccaatatggtatgccgagtctgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccgagcttggcgtaatcatggtcatagctgtttcctgtgtg

SEQ ID NO: 176 - DNA, 20 bp, Artificial Sequence
  Synthetic construct
tattagaaccagggaggtcc

SEQ ID NO: 177 - DNA, 20 bp, Artificial Sequence
  Synthetic construct
agaaaactcttagcttttcc

SEQ ID NO: 178 - DNA, 20 bp, Artificial Sequence
  Synthetic construct
caatatggtatgccgagtct

SEQ ID NO: 179 - DNA, 21 bp, Artificial Sequence
  Synthetic construct
catgtttgacagcttatcatc

SEQ ID NO: 180 - DNA, 21 bp, Artificial Sequence
  Synthetic construct
cacacaggaaacagctatgac

SEQ ID NO: 181 - DNA, 2534 bp, Artificial Sequence
  Synthetic construct
catgcctatccggcggcaacattattactctggtatacgggcgtaactccacgtaaaaactaaaacgagcccccaccaaagaacaaaaaagaaggtgctgggcccccactttcttcccttgcacgtgataggaagatggctacagaaacaagaagatggaaatcgaaggaaagagggagactggaagctgtaaaaactgaaatgaaaaaaaaaaaaaaaaaaaaaaaacaagaagctgaaaatggaagactgaaatttgaaaaatggtaaaaaaaaaaaagaaacacgaagctaaaaacctggattccattttgagaagaagcaagaaaggtaagtatggtaacgaccgtacaggcaagcgcgaaggcaaatggaaaagctggagtccggaagataatcatttcatcttcttttgttagaacagaacagtggatgtccctcatctcggtaacgtattgtccatgccctagaactctctgtccctaaaaagaggacaaaaacccaatggtttccccagcttccagtggagccaccgatcccactggaaaccactggacaggaagagaaaatcacggacttcctctattgaaggataattcaacactttcaccagatcccaaatgtcccgcccctattcccgtgttccatcacgtaccataacttaccatttcatcacgttctctatggcacactggtactgcttcgactgctttgcttcatcttctctatgggccaatgagctaatgagcacaatgtgctgcgaaataaagggatatctaatttatattattacattataatatgtactagtgtggttattggtaattgtacttaattttgatatataaagggtggatctttttcattttgaatcagaattggaattgcaacttgtctcttgtcactattacttaatagtaattatatttcttattaaccttttttttaagtcaaaacaccaaggacaagaactactcttcaaaggtatttcaagttatcatacgtgtcacacacgcttcacagtttcaagtaaaaaaaaagaatattacacaatggactacgctaacatcttgactgccattcctttggaattcaccccacaagatgacattgtcttgttggaaccataccactacttaggtaagaacccaggtaaggaaatcagatctcaattgattgaagctttcaactactggttagatgtcaagaaggaagacttggaagttatccaaaatgttgttggtatgttgcacaccgcttctttgttgatggatgatgttgaagattcttccgtcttgagaagaggttctccagttgctcatttgatctacggtattccacaaaccatcaacactgctaactacgtttacttcttggcttaccaagaaatcttcaaattgcgtccaactccaattccaatgccagttatcccaccatcttctgcttctttgcaatcttctgtctcctccgcctcctcttcctcttctgcctcctctgaaaacggtggtacctccactccaaactcccaaatcccattctccaaggacacctacttggacaaggttatcactgacgaaatgttgtctttgcaccgtggtcaaggtttggaattattctggagagactctttgacctgtccatctgaagaagaatacgtcaagatggtcttgggtaagaccggtggtttgttcagaattgctgtcagattgatgatggccaagtctgaatgtgacattgactttgttcaattggttaacttgatttccatctacttccaaatcagagatgactacatgaacttgcaatcctctgaatacgctcacaacaagaacttcgctgaagacttgactgaaggtaagttctccttcccaaccattcactccattcacgctaacccatcttccagattggttatcaacactttacaaaagaagtccacttctccagaaatcttacatcactgtgtcaactacatgagaactgaaacccactctttcgaatacactcaagaagtcttgaacactttatctggtgctttggaaagagaattgggtagattacaaggtgaatttgctgaagctaactccaagatcgatttgggtgacgttgaatctgaaggtagaaccggtaagaacgtcaaattggaagccatcttgaagaaattggctgatatccctctataaagtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggatgaagtatggatctttgaaacccttttattttattttactttttttagaat

SEQ ID NO: 182 - DNA, 2530 bp, Artificial Sequence
  Synthetic construct
catgcctatccggcggcaacattattactctggtatacgggcgtaactccacctcatcactagaagccgaactgttgtcttcagtggggattggttcgacattttgccaattgctgtcgatgtaccctttcaaagccatgtaccttaaatcttcatccttggcaagtagattcatcgggtgtgtttgaagtaagaatatttgcttgtttttatggtatcaaaggtatatgttgtagaagacaatttccggtaatccaattgtctgtctgctcagtttagcacatgtatagtacgttgcacatagtctacaatattcagcattcagcattcagtatacagcatatggctaaatgatcacaaatgtgattgatgatttgacacgactagaaaagagaacgaaaaagggaaattccatgtcacgtgcgttggcacgtgacatggaatatcgaagaaagaaaaaaaaaacgatctcgtcctagtggaagcccagagtctggtccccccggagtcttcccaaaacaagaagctgacacatgttgacacagaacaccccacagcaaatgcaccacgctacgtagatcaggaagcttaactctagcgacctgtcgctcgccccacagaacctcacccgagaaccacacattacacgccgccagctcccactatactcatcttgcttcccttaagcgttctcacgattcgttcgctgcccttcttcaagagtcttctgattctaattctcattcgaaatcctctacagttaatgaattgcttgacatgacattcattgtctcatggttttggctttttggcttttgtcttttaaagctatatcaactttacatataaatatacgtcaaaaggggattcattaattagaaaattctctttttcaatagttgctattcattatcaatctattcaactcaattggttattattttcatctttttgtcatcctaaaccatcaacaatatttaaatatatctgttgctacattaagagttacttcagaaataacaaaaaaatcgatcaagaattaataaaaatggactacgctaacatcttgactgccattcctttggaattcaccccacaagatgacattgtcttgttggaaccataccactacttaggtaagaacccaggtaaggaaatcagatctcaattgattgaagctttcaactactggttagatgtcaagaaggaagacttggaagttatccaaaatgttgttggtatgttgcacaccgcttctttgttgatggatgatgttgaagattcttccgtcttgagaagaggttctccagttgctcatttgatctacggtattccacaaaccatcaacactgctaactacgtttacttcttggcttaccaagaaatcttcaaattgcgtccaactccaattccaatgccagttatcccaccatcttctgcttctttgcaatcttctgtctcctccgcctcctcttcctcttctgcctcctctgaaaacggtggtacctccactccaaactcccaaatcccattctccaaggacacctacttggacaaggttatcactgacgaaatgttgtctttgcaccgtggtcaaggtttggaattattctggagagactctttgacctgtccatctgaagaagaatacgtcaagatggtcttgggtaagaccggtggtttgttcagaattgctgtcagattgatgatggccaagtctgaatgtgacattgactttgttcaattggttaacttgatttccatctacttccaaatcagagatgactacatgaacttgcaatcctctgaatacgctcacaacaagaacttcgctgaagacttgactgaaggtaagttctccttcccaaccattcactccattcacgctaacccatcttccagattggttatcaacactttacaaaagaagtccacttctccagaaatcttacatcactgtgtcaactacatgagaactgaaacccactctttcgaatacactcaagaagtcttgaacactttatctggtgctttggaaagagaattgggtagattacaaggtgaatttgctgaagctaactccaagatcgatttgggtgacgttgaatctgaaggtagaaccggtaagaacgtcaaattggaagccatcttgaagaaattggctgatatccctctataaagtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggatgaagtatggatctttgaaacccttttattttattttactttttttagaat

SEQ ID NO: 183 - DNA, 2130 bp, Artificial Sequence
  Synthetic construct
catgcctatccggcggcaacattattactctggtatacgggcgtaactccacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaaatggactacgctaacatcttgactgccattcctttggaattcaccccacaagatgacattgtcttgttggaaccataccactacttaggtaagaacccaggtaaggaaatcagatctcaattgattgaagctttcaactactggttagatgtcaagaaggaagacttggaagttatccaaaatgttgttggtatgttgcacaccgcttctttgttgatggatgatgttgaagattcttccgtcttgagaagaggttctccagttgctcatttgatctacggtattccacaaaccatcaacactgctaactacgtttacttcttggcttaccaagaaatcttcaaattgcgtccaactccaattccaatgccagttatcccaccatcttctgcttctttgcaatcttctgtctcctccgcctcctcttcctcttctgcctcctctgaaaacggtggtacctccactccaaactcccaaatcccattctccaaggacacctacttggacaaggttatcactgacgaaatgttgtctttgcaccgtggtcaaggtttggaattattctggagagactctttgacctgtccatctgaagaagaatacgtcaagatggtcttgggtaagaccggtggtttgttcagaattgctgtcagattgatgatggccaagtctgaatgtgacattgactttgttcaattggttaacttgatttccatctacttccaaatcagagatgactacatgaacttgcaatcctctgaatacgctcacaacaagaacttcgctgaagacttgactgaaggtaagttctccttcccaaccattcactccattcacgctaacccatcttccagattggttatcaacactttacaaaagaagtccacttctccagaaatcttacatcactgtgtcaactacatgagaactgaaacccactctttcgaatacactcaagaagtcttgaacactttatctggtgctttggaaagagaattgggtagattacaaggtgaatttgctgaagctaactccaagatcgatttgggtgacgttgaatctgaaggtagaaccggtaagaacgtcaaattggaagccatcttgaagaaattggctgatatccctctataaagtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggatgaagtatggatctttgaaacccttttattttattttactttttttagaat

SEQ ID NO: 184 - DNA, 3428 bp, Artificial Sequence
  Synthetic construct
caaaccgcagattgcgtcacggttctgcggacgccgttagcccattggtgtcaagttttctttttttgcggtcacccccatgtggcggggaggcagaggagtaggtagagcaacgaatcctactatttatccaaattagtctaggaactctttttctagattttttagatttgagggcaagcgctgttaacgactcagaaatgtaagcactacggagtagaacgagaaatccgccataggtggaaatcctagcaaaatcttgcttaccctagctagcctcaggtaagctagccttagcctgtcaaatttttttcaaaatttggtaagtttctactagcaaagcaaacacggttcaacaaaccgaaaactccactcattatacgtggaaaccgaaacaaaaaaacaaaaaccaaaatactcgccaatgagaaagttgctgcgtttctactttcgaggaagaggaactgagaggattgactacgaaaggggcaaaaacgagtcgtattctcccattattgtctgctaccacgcggtctagtagaataagcaaccagtcaacgctaagacaggtaatcaaaataccagtctgctggctacgggctagtttttacctcttttagaacccactgtaaaagtccgttgtaaagcccgttctcactgttggcgtttttttttttttggtttagtttcttatttttcatttttttctttcatgaccaaaaacaaacaaatctcgcgatttgtactgcggccactggggcgtggccaaaaaaatgacaaatttagaaaccttagtttctgatttttcctgttatgaggagatatgataaaaaatattactgctttattgttttttttttatctactgaaatagagaaacttacccaaggaggaggcaaaaaaaagagtatatatacagcaggtaccattcagattttaatatattcttttctcttcttctacactattattataataattttactatattcatttttagcttaaaacctcatagaatattattcttcagtcactcgcttaaatacttatcaaaaatgaccgctttggcttactaccaaatccacttgatctacactttgccaatcttaggtttgctaggtttgttgacttctccaattttgaccaaattcgacatctacaagatttctatcttagtctttattgctttctctgctaccactccatgggactcctggatcatcagaaacggtgcctggacctacccatctgctgaatctggtcaaggtgttttcggtacctttttggatgtcccatacgaagaatacgccttctttgttatccaaaccgtcatcaccggtttggtttacgttttggctaccagacatttgttgccatctttggctctaccaaagacccgttcttctgccttgtctctagctttgaaggctttaatcccattgccaatcatctatttgttcaccgctcatccatctccatccccagatcctttggttactgaccactacttctacatgagagctttgtctttgttgatcaccccaccaaccatgttgttggctgctttatctggtgaatacgctttcgactggaaatctggtagagctaagtccaccattgctgccatcatgatcccaactgtctacttgatctgggttgactacgttgccgttggtcaagactcctggtccatcaacgatgaaaagattgtcggttggagattaggtggtgtcttgccaattgaagaagctatgttcttcttattgaccaacttgatgatcgttttgggtttgtctgcctgtgaccacactcaagccttgtacttgttgcacggtagaactatctacggtaacaagaagatgccatcttctttcccattaatcactccaccagttttgtccttgttcttctcctccagaccatactcctcccaaccaaagagagatttggaattggctgtcaagttgttggaaaagaagtccagatctttcttcgttgcttctgccggtttcccatctgaagtcagagaaagattggttggtttgtacgctttctgtcgtgtcaccgatgacttgattgactctccagaagtttcctccaacccacacgctaccattgacatggtttccgatttcttgactttattattcggtcctccattgcacccatctcaaccagacaagattttgtcttctccattattaccaccttcccacccatccagaccaactggtatgtacccattaccaccacctccatctttgtctccagctgaattggtccaattcttgactgaacgtgtcccagttcaataccacttcgctttcagattgttggccaaattgcaaggtttgattccaagatacccattggatgaattattgagaggttacaccactgacttgatcttcccattgtccactgaagccgtccaagctagaaagaccccaattgaaactactgctgacttgttggactacggtttgtgtgttgccggttctgttgctgaattgttggtctacgtttcctgggcttccgctccatcccaagttccagctactattgaagaaagagaagctgttttggtcgcctctcgtgaaatgggtaccgctttgcaattggtcaacattgccagagatatcaagggtgacgctactgaaggtagattctacttgccattgtctttctttggtttgagagatgaatccaaattggccattccaactgactggactgaaccaagacctcaagatttcgacaaattgttgtctctatctccatcttccactttaccatcctctaacgcttctgaatccttcagattcgaatggaagacctactctttgccattggttgcttacgctgaagatttggctaagcactcttacaagggtattgacagattaccaactgaagtccaagctggtatgagagctgcttgtgcttcttacttgttgattggtcgtgaaatcaaggttgtctggaagggtgatgtcggtgaaagaagaaccgttgctggttggagaagagtcagaaaggttttgtctgttgtcatgtccggttgggaaggtcaataaagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacagaacaatactgattgcgttaccccaagcttatcccacgtagttttgtgtc

SEQ ID NO: 185 - DNA, 3420 bp, Artificial Sequence
  Synthetic construct
cgcagattgcgtcacggttctgcggacgccgttagcccattggtgtcaagcctgtccaagcaaatgccttctcataaatggtgccaaagacccgcaagcccaaagcaattaccccccaaaaagaaatgatatagtgcaagatacgtatatgaccatgacttgactaggtgaaacagtgcagaaacagccgcacaaaagcagccctaaccctcagagtcgattttactctttcaggtaataaagcctcgacatcaattttagacagaagccaggctggcctcgagattatagccataggcaagcaagaggagagaaggggaggccccccatggggggcctcccccccgctgtcaaggtttggcagaacctagcttcattaggccactagcccagcctaaaacgtcaacgggcaggaggaacactcccacaagacggcgtagtattctcgattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgaccgctttggcttactaccaaatccacttgatctacactttgccaatcttaggtttgctaggtttgttgacttctccaattttgaccaaattcgacatctacaagatttctatcttagtctttattgctttctctgctaccactccatgggactcctggatcatcagaaacggtgcctggacctacccatctgctgaatctggtcaaggtgttttcggtacctttttggatgtcccatacgaagaatacgccttctttgttatccaaaccgtcatcaccggtttggtttacgttttggctaccagacatttgttgccatctttggctctaccaaagacccgttcttctgccttgtctctagctttgaaggctttaatcccattgccaatcatctatttgttcaccgctcatccatctccatccccagatcctttggttactgaccactacttctacatgagagctttgtctttgttgatcaccccaccaaccatgttgttggctgctttatctggtgaatacgctttcgactggaaatctggtagagctaagtccaccattgctgccatcatgatcccaactgtctacttgatctgggttgactacgttgccgttggtcaagactcctggtccatcaacgatgaaaagattgtcggttggagattaggtggtgtcttgccaattgaagaagctatgttcttcttattgaccaacttgatgatcgttttgggtttgtctgcctgtgaccacactcaagccttgtacttgttgcacggtagaactatctacggtaacaagaagatgccatcttctttcccattaatcactccaccagttttgtccttgttcttctcctccagaccatactcctcccaaccaaagagagatttggaattggctgtcaagttgttggaaaagaagtccagatctttcttcgttgcttctgccggtttcccatctgaagtcagagaaagattggttggtttgtacgctttctgtcgtgtcaccgatgacttgattgactctccagaagtttcctccaacccacacgctaccattgacatggtttccgatttcttgactttattattcggtcctccattgcacccatctcaaccagacaagattttgtcttctccattattaccaccttcccacccatccagaccaactggtatgtacccattaccaccacctccatctttgtctccagctgaattggtccaattcttgactgaacgtgtcccagttcaataccacttcgctttcagattgttggccaaattgcaaggtttgattccaagatacccattggatgaattattgagaggttacaccactgacttgatcttcccattgtccactgaagccgtccaagctagaaagaccccaattgaaactactgctgacttgttggactacggtttgtgtgttgccggttctgttgctgaattgttggtctacgtttcctgggcttccgctccatcccaagttccagctactattgaagaaagagaagctgttttggtcgcctctcgtgaaatgggtaccgctttgcaattggtcaacattgccagagatatcaagggtgacgctactgaaggtagattctacttgccattgtctttctttggtttgagagatgaatccaaattggccattccaactgactggactgaaccaagacctcaagatttcgacaaattgttgtctctatctccatcttccactttaccatcctctaacgcttctgaatccttcagattcgaatggaagacctactctttgccattggttgcttacgctgaagatttggctaagcactcttacaagggtattgacagattaccaactgaagtccaagctggtatgagagctgcttgtgcttcttacttgttgattggtcgtgaaatcaaggttgtctggaagggtgatgtcggtgaaagaagaaccgttgctggttggagaagagtcagaaaggttttgtctgttgtcatgtccggttgggaaggtcaataaagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacagaacaatactgattgcgttaccccaagcttatcccacgtagttttgtgtc

SEQ ID NO: 186 - DNA, 3025 bp, Artificial Sequence
  Synthetic construct
caaaccgcagattgcgtcacggttctgcggacgccgttagcccattggtgtcaaggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagacaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatgaccgctttggcttactaccaaatccacttgatctacactttgccaatcttaggtttgctaggtttgttgacttctccaattttgaccaaattcgacatctacaagatttctatcttagtctttattgctttctctgctaccactccatgggactcctggatcatcagaaacggtgcctggacctacccatctgctgaatctggtcaaggtgttttcggtacctttttggatgtcccatacgaagaatacgccttctttgttatccaaaccgtcatcaccggtttggtttacgttttggctaccagacatttgttgccatctttggctctaccaaagacccgttcttctgccttgtctctagctttgaaggctttaatcccattgccaatcatctatttgttcaccgctcatccatctccatccccagatcctttggttactgaccactacttctacatgagagctttgtctttgttgatcaccccaccaaccatgttgttggctgctttatctggtgaatacgctttcgactggaaatctggtagagctaagtccaccattgctgccatcatgatcccaactgtctacttgatctgggttgactacgttgccgttggtcaagactcctggtccatcaacgatgaaaagattgtcggttggagattaggtggtgtcttgccaattgaagaagctatgttcttcttattgaccaacttgatgatcgttttgggtttgtctgcctgtgaccacactcaagccttgtacttgttgcacggtagaactatctacggtaacaagaagatgccatcttctttcccattaatcactccaccagttttgtccttgttcttctcctccagaccatactcctcccaaccaaagagagatttggaattggctgtcaagttgttggaaaagaagtccagatctttcttcgttgcttctgccggtttcccatctgaagtcagagaaagattggttggtttgtacgctttctgtcgtgtcaccgatgacttgattgactctccagaagtttcctccaacccacacgctaccattgacatggtttccgatttcttgactttattattcggtcctccattgcacccatctcaaccagacaagattttgtcttctccattattaccaccttcccacccatccagaccaactggtatgtacccattaccaccacctccatctttgtctccagctgaattggtccaattcttgactgaacgtgtcccagttcaataccacttcgctttcagattgttggccaaattgcaaggtttgattccaagatacccattggatgaattattgagaggttacaccactgacttgatcttcccattgtccactgaagccgtccaagctagaaagaccccaattgaaactactgctgacttgttggactacggtttgtgtgttgccggttctgttgctgaattgttggtctacgtttcctgggcttccgctccatcccaagttccagctactattgaagaaagagaagctgttttggtcgcctctcgtgaaatgggtaccgctttgcaattggtcaacattgccagagatatcaagggtgacgctactgaaggtagattctacttgccattgtctttctttggtttgagagatgaatccaaattggccattccaactgactggactgaaccaagacctcaagatttcgacaaattgttgtctctatctccatcttccactttaccatcctctaacgcttctgaatccttcagattcgaatggaagacctactctttgccattggttgcttacgctgaagatttggctaagcactcttacaagggtattgacagattaccaactgaagtccaagctggtatgagagctgcttgtgcttcttacttgttgattggtcgtgaaatcaaggttgtctggaagggtgatgtcggtgaaagaagaaccgttgctggttggagaagagtcagaaaggttttgtctgttgtcatgtccggttgggaaggtcaataaagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacagaacaatactgattgcgttaccccaagcttatcccacgtagttttgtgtc

SEQ ID NO: 187 - DNA, 2748 bp, Artificial Sequence
  Synthetic construct
gtccttgtatggaagtatcaaaggggacgttcttcacctccttggaacaaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctgttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgacacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaatagaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtcgatgggacgtcagcactgtacttgtttttgcgactagattgtaaatcattc

SEQ ID NO: 188 - DNA, 2749 bp, Artificial Sequence
  Synthetic construct
cgtccttgtatggaagtatcaaaggggacgttcttcacctccttggaaaacatatatacacaattacagtaacaataacaagaggacagatactaccaaaatgtgtggggaagcgggtaagctgccacagcaattaatgcacaacatttaacctacattcttccttatcggatcctcaaaacccttaaaaacatatgcctcaccctaacatattttccaattaaccctcaatatttctctgtcacccggcctctattttccattttcttctttacccgccacgcgtttttttctttcaaatttttttcttctttcttctttttcttccacgtcctcttgcataaataaataaaccgttttgaaaccaaactcgcctctctctctcctttttgaaatatttttgggtttgtttgatcctttccttcccaatctctcttgtttaatatatattcatttatatcacgctctctttttatcttcctttttttcctctctcttgtattcttccttcccctttctactcaaaccaagaagaaaaagaaaaggtcaatctttgttaaagaataggatcttctactacatcagcttttagatttttcacgcttactgcttttttcttcccaagatcgaaaatttactgaattaacaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtcgatgggacgtcagcactgtacttgtttttgcgactagattgtaaatcattc

SEQ ID NO: 189 - DNA, 3149 bp, Artificial Sequence
  Synthetic construct
cgtccttgtatggaagtatcaaaggggacgttcttcacctccttggaacgtatccctatctggattaacatcactgccacagatcgaattgcaagaagccacacttcacgtgatccactcgttcatcaggtttgtagcttcatggcgcaggacttctgatgatgaactatctggctcatccggatggatcacaaggatggataccctcagacagtacgtttccgtatggagcgatcttacaagaaccaacagttgatcctattactttttttttattttttgtccctccgggatggcaagagggacaaagaagaatcttcgttcttctttcttgttctcaacttcccagcttccgtgtgattaccctccgggacaacagaaaaactggcattcggtatcccgggaatctgctgagaaggaaagaaaacgaaaaaaaaattgtacatttgtgtcacattatgaattacaggaagtcagaaaacaggcagcacatgtctcgcacatgcatgtccatcagacgagacattatgagacatgcacgcgtgtgagagacatagcaaaagtctctccagtacacacagaaagacacgttcacaatccaggcaccccacagagaaaaaaaaaagaagaagcccggaagctggcacgccatcatcaaccaccgctcggtttacacgcatcccaactgtcttttttttctggaatcctataataactggcatctggaaatcacgttgtatgttgcaccatagtgactggctgtctgactagcaaacattgattccctgattcccatttggctcaattttgatgagaaacagttgattgattcttgtcaatttttttttctttggaccaccaccaaccaattgacattgaagtactttcccatgatttgaggttatataaaaggacgttcaaatcactttcaaggttaattcagttttgtcaattgatttaagttcaattgttaacaaatttaatttaattcgaaacaaaccaaaccaattcatttgaattaacaaaccaacccacaaaacaaaaaaaaatgggtaaggaacaagaccaagacaagccaactgccatcatcgttggttgtggtatcggtggtattgctaccgctgccagattagctaaggaaggtttccaagttaccgtctttgaaaagaacgactactccggtggtagatgttctttgattgaaagagatggttacagattcgaccaaggtccatctttgttgctattaccagacttgttcaagcaaaccttcgaagatttgggtgaaaagatggaagactgggttgatttgatcaagtgtgaaccaaactacgtttgtcacttccatgatgaagaaactttcaccttctccactgacatggctttattgaagagagaagtcgaaagatttgaaggtaaagatggtttcgacagattcttgtctttcatccaagaagctcacagacattacgaattggctgttgtccacgtcttgcaaaagaacttcccaggtttcgctgctttcttgagattacaattcatcggtcaaatcttagctttgcacccatttgaatccatctggaccagagtttgtcgttacttcaagactgacagattgagaagagtcttctcctttgccgttatgtacatgggtcaatctccatactctgctccaggtacctactccttgttgcaatacactgaattgactgaaggtatctggtacccaagaggtggtttctggcaagttccaaacactttgttgcaaatcgtcaagagaaacaacccatctgctaagttcaacttcaacgctccagtttctcaagttttgttgtctccagctaaggacagagctaccggtgtcagattagaatctggtgaagaacaccacgctgatgttgtcattgtcaatgctgacttggtctacgcttctgaacatttgattccagatgatgctagaaacaagatcggtcaattaggtgaagttaagcgttcctggtgggctgatttggttggtggtaagaagttgaagggttcttgttcttctttgtctttctactggtctatggacagaatcgttgacggtttgggtggtcacaacatcttcttggctgaagacttcaagggttccttcgacaccattttcgaagaattgggtttgccagctgacccatctttctatgttaacgttccatccagaattgacccttctgctgctccagaaggtaaggatgccattgtcatcttagtcccatgtggtcacatcgatgcttccaaccctcaagactacaacaaattggttgccagagccagaaagttcgtcatccaaaccttgtctgccaagttgggtctaccagatttcgaaaagatgattgttgctgaaaaggttcacgatgctccatcctgggaaaaggaattcaacttgaaggacggttccattttgggtttggctcacaacttcatgcaagtcttgggtttcagaccatccaccagacacccaaagtacgacaaattgttctttgtcggtgcttctacccacccaggtactggtgttccaattgtcttggctggtgccaaattgactgctaaccaagttttggaatccttcgatcgttctccagctccagatcctaacatgtctttgtctgttccatacggtaagccattgaaatccaacggtactggtattgactctcaagtccaattgaaattcatggacttggaacgttgggtttacctattagtcttgttgattggtgctgttatcgccagatccgtcggtgtcttggccttttaaaggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtcgatgggacgtcagcactgtacttgtttttgcgactagattgtaaatcattc

SEQ ID NO: 190 - DNA, 71 bp, Artificial Sequence
  Synthetic construct
catgcctatccggcggcaacattattactctggtatacgggcgtaactccacgtaaaaactaaaacgagcc

SEQ ID NO: 191 - DNA, 74 bp, Artificial Sequence
  Synthetic construct
attctaaaaaaagtaaaataaaataaaagggtttcaaagatccatacttcatcctggcggaaaaaattcatttg

SEQ ID NO: 192 - DNA, 72 bp, Artificial Sequence
  Synthetic construct
catgcctatccggcggcaacattattactctggtatacgggcgtaactccacctcatcactagaagccgaac

SEQ ID NO: 193 - DNA, 71 bp, Artificial Sequence
  Synthetic construct
catgcctatccggcggcaacattattactctggtatacgggcgtaactccacttggcttcacatacgttgc

SEQ ID NO: 194 - DNA, 84 bp, Artificial Sequence
  Synthetic construct
caaaccgcagattgcgtcacggttctgcggacgccgttagcccattggtgtcaagttttctttttttgcggtcacccccatgtg

SEQ ID NO: 195 - DNA, 70 bp, Artificial Sequence
  Synthetic construct
gacacaaaactacgtgggataagcttggggtaacgcaatcagtattgttctgttccttaatcaaggatac

SEQ ID NO: 196 - DNA, 73 bp, Artificial Sequence
  Synthetic construct
cgcagattgcgtcacggttctgcggacgccgttagcccattggtgtcaagcctgtccaagcaaatgccttctc

SEQ ID NO: 197 - DNA, 80 bp, Artificial Sequence
  Synthetic construct
caaaccgcagattgcgtcacggttctgcggacgccgttagcccattggtgtcaaggctgataatagcgtataaacaatgc

SEQ ID NO: 198 - DNA, 71 bp, Artificial Sequence
  Synthetic construct
gtccttgtatggaagtatcaaaggggacgttcttcacctccttggaacaaacattaatttgttctgcatac

SEQ ID NO: 199 - DNA, 72 bp, Artificial Sequence
  Synthetic construct
gaatgatttacaatctagtcgcaaaaacaagtacagtgctgacgtcccatcgacgttgatttaaggtggttc

SEQ ID NO: 200 - DNA, 73 bp, Artificial Sequence
  Synthetic construct
cgtccttgtatggaagtatcaaaggggacgttcttcacctccttggaaaacatatatacacaattacagtaac

SEQ ID NO: 201 - DNA, 74 bp, Artificial Sequence
  Synthetic construct
cgtccttgtatggaagtatcaaaggggacgttcttcacctccttggaacgtatccctatctggattaacatcac

SEQ ID NO: 202 - DNA, 516 bp, Artificial Sequence
  Synthetic construct
catgtttgacagcttatcatcgataatccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctacccgatcccgaagaaagtccaactccagttcgattccctgctttcgagt

SEQ ID NO: 203 - DNA, 488 bp, Artificial Sequence
  Synthetic construct
acccgatcccgaagaaagtccaactccagttcgattccctgctttcgagttctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatcagaaaactcttagcttttccgttttagagctagaaatagcaagttaaaataaggctagtccgttatcaacttgaaaaagtggcaccgagtcggtggtgctttttttgttttttatgtcttcctcggatcggccagttgggagcaaggtggtacttctgtcgtcgtattt

SEQ ID NO: 204 - DNA, 525 bp, Artificial Sequence
  Synthetic construct
tcctcggatcggccagttgggagcaaggtggtacttctgtcgtcgtattttctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatccaatatggtatgccgagtctgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccgagcttggcgtaatcatggtcatagctgtttcctgtgtg

SEQ ID NO: 205 - DNA, 22 bp, Artificial Sequence
  Synthetic construct
actcgaaagcagggaatcgaac

SEQ ID NO: 206 - DNA, 20 bp, Artificial Sequence
  Synthetic construct
acccgatcccgaagaaagtc

SEQ ID NO: 207 - DNA, 21 bp, Artificial Sequence
  Synthetic construct
aaatacgacgacagaagtacc

SEQ ID NO: 208 - DNA, 19 bp, Artificial Sequence
  Synthetic construct
tcctcggatcggccagttg

SEQ ID NO: 209 - DNA, 150 bp, Artificial Sequence
  Synthetic construct
cataagctaattatgccatccatatagcaagagaatccggtgggggcgccatgcctatccggcggcaacattattactctggtatacgggcgtaactccaaagcgacttccaatcgctttgcatatccagtaccacacccacaggcgttt

SEQ ID NO: 210 - DNA, 150 bp, Artificial Sequence
  Synthetic construct
agaaagcctgtatgcgaagccacaatcctttccaacagaccatactaagttattttattttactttttttagaatgacctgttcccgacactatgtaagatctagcttttaacatattatggaaacctgaaatgtaaaatctgaattttt

SEQ ID NO: 211 - DNA, 20 bp, Artificial Sequence
  Synthetic construct
agaaagcctgtatgcgaagc

SEQ ID NO: 212 - DNA, 22 bp, Artificial Sequence
  Synthetic construct
tcggaattaaccctcactaaag

SEQ ID NO: 213 - DNA, 488 bp, Artificial Sequence
  Synthetic construct
cggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccga

SEQ ID NO: 214 - DNA, 800 bp, Artificial Sequence
  Synthetic construct
agaaagcctgtatgcgaagccacaatcctttccaacagaccatactaagttattttattttactttttttagaatgacctgttcccgacactatgtaagatctagcttttaacatattatggaaacctgaaatgtaaaatctgaatttttgagacccataagctaattatgccatccatatagcaagagaatccggtgggggcgccatgcctatccggcggcaacattattactctggtatacgggcgtaactccaaagcgacttccaatcgctttgcatatccagtaccacacccacaggcgtttgagacccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccga

SEQ ID NO: 215 - DNA, 856 bp, Artificial Sequence
  Synthetic construct
agaaagcctgtatgcgaagccacaatcctttccaacagaccatactaagttattttattttactttttttagaatgacctgttcccgacactatgtaagatctagcttttaacatattatggaaacctgaaatgtaaaatctgaatttttgagacccgattcaggtccgtacgcgatgggtctccataagctaattatgccatccatatagcaagagaatccggtgggggcgccatgcctatccggcggcaacattattactctggtatacgggcgtaactccaaagcgacttccaatcgctttgcatatccagtaccacacccacaggcgtttgagacccgattcaggtccgtacgcgatgggtctccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccga

SEQ ID NO: 216 - DNA, 601 bp, Artificial Sequence
  Synthetic construct
tatagtccgtggaattaattctcatgtttgacagcttatcatcgataatccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctgaattctattagaaccagggaggtccctcgaggttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccgagcttggcgtaatcatggtcatagctgtttcctgtgtgaaattgttatccg

SEQ ID NO: 217 - DNA, 6074 bp, Artificial Sequence
  Synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatggttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacacctaggatccgtcgacactggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactaggggcagggcatgctcatgtagagcgcctgctcgccgtccgaggcggtgccgtcgtacagggcggtgtccaggccgcagagggtgaaccccatccgccggtacgcgtggatcgccggtgcgttgacgttggtgacctccagccagaggtgcccggcgccccgctcgcgggcgaactccgtcgcgagccccatcaacgcgcgcccgaccccgtgcccccggtgctccggggcgacctcgatgtcctcgacggtcagccggcggttccagccggagtacgagacgaccacgaagcccgccaggtcgccgtcgtccccgtacgcgacgaacgtccgggagtccgggtcgccgtcctccccggcgtccgattcgtcgtccgattcgtcgtcggggaacaccttggtcaggggcgggtccaccggcacctcccgcagggtgaagccgtccccggtggcggtgacgcggaagacggtgtcggtggtgaaggacccatccagtgcctcgatggcctcggcgtcccccgggacactggtgcggtaccggtaagccgtgtcgtcaagagtggtcattttacatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgaggccttaagttcgaacgtacgagctccggcattgcgaataccgctttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttaacaaagatatgctattgaagtgcaagatggaaacgcagaaaatgaaccggggatgcgacgtgcaagattacctatgcaatagatgcaatagtttctccaggaaccgaaatacatacattgtcttccgtaaagcgctagactatatattattatacaggttcaaatatactatctgtttcagggaaaactcccaggttcggatgttcaaaattcaatgatgggtaacaagtacgatcgtaaatctgtaaaacagtttgtcggatattaggctgtatctcctcaaagcgtattcgaatatcattgagaagctgcagcgtcacatcggataataatgatggcagccattgtagaagtgccttttgcatttctagtctctttctcggtctagctagttttactacatcgcgaagatagaatcttagatcacactgcctttgctgagctggatcaatagagtaacaaaagagtggtaaggcctcgttaaaggacaaggacctgagcggaagtgtatcgtacagtagacggagtatactaggtatagtctatagtccgtggaattaattctcatgtttgacagcttatcatcgataatccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctgaattctattagaaccagggaggtccctcgaggttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 218 - DNA, 432 bp, Artificial Sequence
  Synthetic construct
agaaagcctgtatgcgaagccacaatcctttccaacagaccatactaagttattttattttactttttttagaatgacctgttcccgacactatgtaagatctagcttttaacatattatggaaacctgaaatgtaaaatctgaatttttgagacccataagctaattatgccatccatatagcaagagaatccggtgggggcgccatgcctatccggcggcaacattattactctggtatacgggcgtaactccaaagcgacttccaatcgctttgcatatccagtaccacacccacaggcgtttgagacctgcgcatgtttcggcgttcgaaacttctccgcagtgaaagataaatgatctattagaaccagggaggtccgttttagagctagaaatagcaagttaaaataaggctagtccgttatcaac

SEQ ID NO: 219 - DNA, 488 bp, Artificial Sequence
  Synthetic construct
agaaagcctgtatgcgaagccacaatcctttccaacagaccatactaagttattttattttactttttttagaatgacctgttcccgacactatgtaagatctagcttttaacatattatggaaacctgaaatgtaaaatctgaatttttgagacccgattcaggtccgtacgcgatgggtctccataagctaattatgccatccatatagcaagagaatccggtgggggcgccatgcctatccggcggcaacattattactctggtatacgggcgtaactccaaagcgacttccaatcgctttgcatatccagtaccacacccacaggcgtttgagacccgattcaggtccgtacgcgatgggtctctgcgcatgtttcggcgttcgaaacttctccgcagtgaaagataaatgatctattagaaccagggaggtccgttttagagctagaaatagcaagttaaaataaggctagtccgttatcaac

SEQ ID NO: 220 - DNA, 120 bp, Artificial Sequence
  Synthetic construct
tgcgcatgtttcggcgttcgaaacttctccgcagtgaaagataaatgatctattagaaccagggaggtccgttttagagctagaaatagcaagttaaaataaggctagtccgttatcaac

SEQ ID NO: 221 - DNA, 915 bp, Artificial Sequence
  Synthetic construct
agaaagcctgtatgcgaagccacaatcctttccaacagaccatactaagtcagtcagtgggtcctttccgtgcaagattctattttattttactttttttagaatgacctgttcccgacactatgtaagatctagcttttaacatattatggaaacctgaaatgtaaaatctgaatttttgagacccgattcaggtccgtacgcgatgggtctccataagctaattatgccatccatatagcaagagaatccggtgggggcgccatgcctatccggcggcaacattattactctggtatacgggcgtaactccaagttcgggtattgttcgagcagtcagtcaaagcgacttccaatcgctttgcatatccagtaccacacccacaggcgtttgagacccgattcaggtccgtacgcgatgggtctccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccga

SEQ ID NO: 222 - DNA, 915 bp, Artificial Sequence
  Arificial construct
agaaagcctgtatgcgaagccacaatcctttccaacagaccatactaagtcagtcagtgcgtcctttccgtgcaagattcgatgataccgaaggctgaaccgtaaatgccaaaaacgaatctttgggccaaggtgaaaccgattttccaatcataaccggggtaagagttggccatagtggagacccgattcaggtccgtacgcgatgggtctcatttccaaacaacaggcctgtgtatttttgggataccattccaactgatctggcgcagatcctgttgatttatgattgtcttatctttcaaaatattgtcagttcgggtattgttcgagcagtcagtacaagcgacttccaatcgctttgcatatccagtaccacacccacaggcgtttgagacccgattcaggtccgtacgcgatgggtctccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccga

SEQ ID NO: 223 - DNA, 915 bp, Artificial Sequence
  Synthetic construct
agaaagcctgtatgcgaagccacaatcctttccaacagaccatactaagtcagtcagtgcgtcctttccgtgcaagattctttttttcaaggcccttttgttttgtaaacaaagaaatttcacaaagtgagcgtctactaatattgataatgccatttccacattacaactactgctagggagacccgattcaggtccgtacgcgatgggtctcactttgccttctttgtcacagccatattttgcctcgaacgatcacctttcatcgtaggctatccaatagacgtcaaatgccttgctgaccactacagaacagttcgggtattgttcgagcagtcagtaaaagcgacttccaatcgctttgcatatccagtaccacacccacaggcgtttgagacccgattcaggtccgtacgcgatgggtctccggagctagcatgcggccgctctagaactagtggatcccccgggctgcagtctttgaaaagataatgtatgattatgctttcactcatatttatacagaaacttgatgttttctttcgagtatatacaaggtgattacatgtacgtttgaagtacaactctagattttgtagtgccctcttgggctagcggtaaaggtgcgcattttttcacaccctacaatgttctgttcaaaagattttggtcaaacgctgtagaagtgaaagttggtgcgcatgtttcggcgttcgaaacttctccgcagtgaaagataaatgatctattagaaccagggaggtccgttttagagctagaaatagcaagttaaaataaggctagtccgttatcaacttgaaaaagtggcaccgagtcggtggtgctttttttgttttttatgtctggggggcccggtacccagcttttgttccctttagtgagggttaattccga

SEQ ID NO: 224 - DNA, 22 bp, Artificial Sequence
  Synthetic construct
aagcgacttccaatcgctttgc

SEQ ID NO: 225 - DNA, 24 bp, Artificial Sequence
  Synthetic construct
acttagtatggtctgttggaaagg

SEQ ID NO: 226 - DNA, 19 bp, Artificial Sequence
  Synthetic construct
agttcgggtattgttcgag

SEQ ID NO: 227 - DNA, 20 bp, Artificial Sequence
  Synthetic construct
gtcagtttcaaccgaggtgg

SEQ ID NO: 228 - DNA, 21 bp, Artificial Sequence
  Synthetic construct
gcttttgattaagccttctag

SEQ ID NO: 229 - DNA, 20 bp, Artificial Sequence
  Synthetic construct
gaatcttgcacggaaaggac
